(12) United States Patent
Gudbjartsson et al.

(10) Patent No.: US 8,367,333 B2
(45) Date of Patent: Feb. 5, 2013

(54) GENETIC VARIANTS AS MARKERS FOR USE IN DIAGNOSIS, PROGNOSIS AND TREATMENT OF EOSINOPHILIA, ASTHMA, AND MYOCARDIAL INFARCTION

(75) Inventors: Daniel Gudbjartsson, Reykjavík (IS); Unnur S. Bjornsdottir, Seltjarnarnes (IS); Patrick Sulem, Reykjavík (IS)

(73) Assignee: deCODE Genetics ehf., Reykjavik (IS)

( * ) Notice: Subject to any disclaimer, the term of this patent is extended or adjusted under 35 U.S.C. 154(b) by 408 days.

(21) Appl. No.: 12/636,082

(22) Filed: Dec. 11, 2009

(65) Prior Publication Data
US 2010/0160802 A1    Jun. 24, 2010

Related U.S. Application Data

(60) Provisional application No. 61/122,267, filed on Dec. 12, 2008.

(51) Int. Cl.
*C12P 19/34* (2006.01)
(52) U.S. Cl. ......... 435/6.1; 435/6.11; 435/6.12; 435/7.1
(58) Field of Classification Search .................. None
See application file for complete search history.

(56) References Cited

U.S. PATENT DOCUMENTS 4,851,330 A   7/1989 Kohne
5,288,611 A   2/1994 Kohne

FOREIGN PATENT DOCUMENTS

WO    WO-93/22456    11/1993
WO    WO-2009/103995  8/2009
WO    WO-2010/067381  6/2010

OTHER PUBLICATIONS

Hegele (2002) Arterioscler Thromb Vasc Biol 2002;22;1058-1061.*
Pennisi (1998) Science, New Series, vol. 281, No. 5384. p. 1787-1789.*
Lucentini (2004) The Scientist. Dec. 20, 2004, p. 20.*
Terwilliger and Hiekkalinna European Journal of Human Genetics (2006) 14, 426-437.*
Zill et al.Molecular Psychiatry (2004) 9, 1030-1036.*
Langdahl (Journal of Bone and Mineral Research 2000 vol. 15, No. 3, pp. 402-414).*
Wall (Nature Reviews Genetics (2003) vol. 4, pp. 587-597).*
Andiappan (BMC Genetics. 2010. 11: 36).*
Sotos et al. Statistics Education Research Journal 2009, Nov. 8(2):33-55.*
Hunninghake et al., Polymorphisms in IL 13, total IgE, eosiophilia, and asthma exacerbatations in childhood, *Allergy Clin. Immunol.* 120(1): 84-90 (2007).
Hunt et al., Novel ciliac disease genetic determinants related to the immune response, *Nat. Genet.* 40(4): 395-402 (2008).
Reijemerink et al., Associate of ILRL1, IL 18R1, and IL 1RAP gene cluster polymorphisms with asthma and atopy, *J. Allergy Clin. Immunol.* 122(3): 651-54 (2008).

International Search Report, PCT/IS2009/000015, dated Mar. 5, 2010.
A haplotype map of the human genome. *Nature*, 437: 1299-320 (2005).
A second generation human haplotype map of over 3.1 million SNPs. *Nature*, 449: 851-61 (2007).
Amundadottir et al., A common variant associated with prostate cancer in European and African populations. *Nat. Genet.* 38: 652-8 (2006).
Barrett et al., Evaluating coverage of genome-wide association studies. *Nat. Genet.* 38: 659-62 (2006).
British guideline on the management of asthma. *Thorax*, 58: i1-84 (2003).
Britton et al., Factors influencing the occurrence of airway hyper-reactivity in the general population: the importance of atopy and airway calibre. *Eur. Respir. J.* 7: 881-7 (1994).
Carriere et al., IL-33, the IL-1-like cytokine ligand for ST2 receptor, is a chromatin-associated nuclear factor in vivo. *Proc. Natl. Acad. Sci. USA*, 104: 282-7 (2007).
Cherry et al., A novel IL-1 family cytokine, IL-33, potently activates human eosinophils. *J. Allergy Clin. Immunol.* 121: 1484-90 (2008).
Danesh et al., Association of fibrinogen, C-reactive protein, albumin, or leukocyte count with coronary heart disease: meta-analyses of prospective studies. *JAMA*, 279: 1477-82 (1998).
Devlin et al., Genomic control to the extreme. *Nat. Genet.* 36: 1129-30 (2004).
Fitau et al., The adaptor molecule Lnk negatively regulates tumor necrosis factor-alpha-dependent VCAM-1 expression in endothelial cells through inhibition of the ERK1 and -2 pathways. *J. Biol. Chem.* 281: 20148-59 (2006).
Frayling, Genome-wide association studies provide new insights into type 2 diabetes aetiology. *Nat. Rev. Genet.* 8: 657-62 (2007).
Genome-wide association study of 14,000 cases of seven common diseases and 3,000 shared controls. *Nature*, 447: 661-78 (2007).
Gibbs et al., Detection of single DNA base difference by competitive oligonucleotide priming. *Nucl. Acids Res.* 17: 2437-48 (1989).
Girelli et al., Polymorphisms in the factor VII gene and the risk of myocardial infarction in patients with coronary artery disease. *N. Engl. J. Med.* 343: 774-80 (2000).
Grant et al., Variant of transcription factor 7-like 2 (TCF7L2) gene confers risk of type 2 diabetes. *Nat. Genet.* 38: 320-3 (2006).
Gretarsdottier et al., Processing of tRNA precursors in higher organisms. *Nat. Genet.* 35: 131-8 (2003).

(Continued)

*Primary Examiner* — Juliet Switzer
(74) *Attorney, Agent, or Firm* — Marshall, Gerstein & Borun LLP

(57) ABSTRACT

Polymorphic variants (e.g., certain alleles of polymorphic markers) that have been found to be associated with high blood eosinophil counts, conditions causative of eosinophilia (e.g., asthma, myocardial infarction), and/or hypertension are provided herein. Such polymorphic markers are useful for diagnostic purposes, such as in methods of determining a susceptibility, and for prognostic purposes, including methods of predicting prognosis and methods of assessing an individual for probability of a response to a therapeutic agent, as further described herein. Further applications utilize the polymorphic markers of the invention include, screening methods and genotyping methods. The invention furthermore provides related kits, computer-readable medium, and apparatus.

35 Claims, 20 Drawing Sheets

OTHER PUBLICATIONS

Gudbjartsson et al., ASIP and TYR pigmentation variants associate with cutaneous melanoma and basal cell carcinoma. *Nat. Genet.* 40: 886-91 (2008).
Gudbjartsson et al., Sequence variants affecting eosinophil numbers associate with asthma and myocardial infarction. *Nat. Genet.* 41(3): 342-7 (2009).
Gudmundsson et al., Common sequence variants on 2p15 and Xp11.22 confer susceptibility to prostate cancer. *Nat. Genet.* 40: 281-3 (2008).
Gudmundsson et al., Genome-wide association study identifies a second prostate cancer susceptibility variant at 8q24. *Nat. Genet.* 39: 631-7 (2007).
Heinzmann et al., Association study of the IL13 variant Arg110Gin in atopic diseases and juvenile idiopathic arthritis. *J. Allergy Clin. Immunol.* 112: 735 (2003).
Helgadottir et al., A common variant on chromosome 9p21 affects the risk of myocardial infarction. *Science*, 316: 1491 (2007).
Hirasawa et al., Essential and instructive roles of GATA factors in eosinophil development. *J. Exp. Med.* 195: 1379-86 (2002).
Hogan et al., Eosinophils: biological properties and role in health and disease. *Clin. Exp. Allergy*, 38: 709-50 (2008).
Hunt et al., Newly identified genetic risk variants for celiac disease related to the immune response. *Nat. Genet.* 16: 1083-90 (2008).
Iwasaki et al., The order of expression of transcription factors directs hierarchical specification of hematopoietic lineages. *Genes Dev.* 20: 3010-21 (2006).
Janson et al., The effect of infectious burden on the prevalence of atopy and respiratory allergies in Iceland, Estonia, and Sweden. *J. Allergy Clin. Immunol.* 120: 673 (2007).
Jones et al., Angiotensin II type 1 receptor 1166C polymorphism is associated with abdominal aortic aneurysm in three independent cohorts. *Arterioscler. Thromb. Vasc. Biol.* 28: 764-70 (2008).
Kedda et al., Characterization of two polymorphisms in the leukotriene C4 synthase gene in an Australian population of subjects with mild, moderate, and severe asthma. *J. Allergy Clin. Immunol.* 113: 889 (2004).
Kim et al., A promoter nucleotide variant of the dendritic cell-specific DCNP1 associates with serum IgE levels specific for dust mite allergens among the Korean asthmatics. *Genes Immunol.* 8: 369-78 (2007).
Koppelman et al., Genome-wide search for atopy susceptibility genes in Dutch families with asthma. *J Allergy Clin. Immunol.* 109: 498 (2002).
Kutyavin et al., A novel endonuclease IV post-PCR genotyping system. *Nucl. Acids Res.* 34: e128 (2006).
Lee et al., Defining a link with asthma in mice congenitally deficient in eosinophils. *Science*, 305: 1773-6 (2004).
Mao et al., T lymphocyte activation gene identification by coregulated expression on DNA microarrays. *Genomics*, 83: 989-99 (2004).
Martinez-Moczygemba et al., Biology of common beta receptor-signaling cytokines: IL-3, IL-5, and GM-CSF. *J. Allergy Clin. Immunol.* 112: 653-65, quiz 666 (2003).
Menzel et al., The HBS1L-MYB intergenic region on chromosome 6q23.3 influences erythrocyte, platelet, and monocyte counts in humans. *Blood*, 110: 3624-6 (2007).
Newton-Cheh et al., Genome-wise association study identifies eight loci associated with blood pressure. *Nat. Genet.* 41(6): 666-76 (2009).

Postma et al., Genomewide screen for pulmonary function in 200 families ascertained for asthma. *Am. J. Respir. Crit. Care Med.* 172: 446-52 (2005).
Saiki et al., Analysis of enzymatically amplified beta-globin and HLA-DQ alpha DNA with allele-specific oligonucleotide probes. *Nature*, 324: 163-6 (1986).
Schmitz et al., IL-33, an interleukin-1-like cytokine that signals via the IL-1 receptor-related protein ST2 and induces T helper type 2-associated cytokines. *Immunity*, 23: 479-90 (2005).
Shimizu et al., Functional SNPs in the distal promoter of the ST2 gene are associated with atopic dermatitis. *Hum. Mol. Genet.* 14: 29191-27 (2005).
Soranzo et al., A genome-wide meta-analysis identifies 22 loci associated with either hematological parameters in the HaemGen consortium. *Nat. Genet.* 41(11): 1182-90 (2009).
Stacey et al., Common variants on chromosomes 2q35 and 16q12 confer susceptibility to estrogen receptor-positive breast cancer. *Nat. Genet.* 39: 865-9 (2007).
Steinthorsdottir et al., A variant in CDKAL1 influences insulin response and risk of type 2 diabetes. *Nat. Genet.* 39: 770-5 (2007).
Styrkarsdottir et al., Multiple genetic loci for bone mineral density and fractures. *N. Engl. J. Med.* 358: 2355-65 (2008).
Tago et al., Tissue distribution and subcellular localization of a variant form of the human ST2 gene product, ST2V. *Biochem. Biophys. Res. Commun.* 285: 1377-83 (2001).
The International HapMap Project. *Nature*, 426: 789-96 (2003).
Thein et al., Intergenic variants of HBS1L-MYB are responsible for a major quantitative trait locus on chromosome 6q23 influencing fetal hemoglobin levels in adults. *Proc. Natl. Acad. Sci. USA.* 104: 11346-51 (2007).
Thorgeirsson et al., A variant associated with nicotine dependence, lung cancer and peripheral arterial disease. *Nature*, 452: 638-42 (2008).
Todd et al., Robust associations of four new chromosome regions from genome-wide analyses of type 1 diabetes. *Nat. Genet.* 39: 857-64 (2007).
Van Diemen et al., A disintegrin and metalloprotease 33 polymorphisms and lung function decline in the general population. *Am. J. Respir. Crit. Care. Med.* 172: 329-33 (2005).
Velazquez et al., Cytokine signaling and hematopoietic homeostasis are disrupted in Lnk-deficient mice. *J. Exp. Med.* 195: 1599-611 (2002).
Vitart et al., SLC2A9 is a newly identified urate transporter influencing serum urate concentration, urate excretion and gout. *Nat. Genet.* 40: 437-42 (2008).
Wheatley et al., Identification of the autoantigen SART-1 as a candidate gene for the development of atopy. *Hum. Mol. Genet.* 11: 2143-6 (2002).
Ying et al., Thymic stromal lymphopoietin expression is increased in asthmatic airways and correlates with expression of Th2-attracting chemokines and disease severity. *J. Immunol.* 174: 8183-90 (2005).
Zhernakova et al., Genetic analysis of innate immunity in Crohn's disease and ulcerative colitis identifies two susceptibility loci harboring CARD9 and IL18RAP. *Am. J. Hum. Genet.* 82: 1202-10 (2008).
Zhou et al., Thymic stromal lymphopoietin as a key initiator of allergic airway inflammation in mice. *Nat. Immunol.* 6: 1047-53 (2005).
Zhu et al., Interleukin 18 receptor 1 gene polymorphisms are associated with asthma. *Eur. J. Hum. Genet.* 16: 1083-90 (2008).

\* cited by examiner

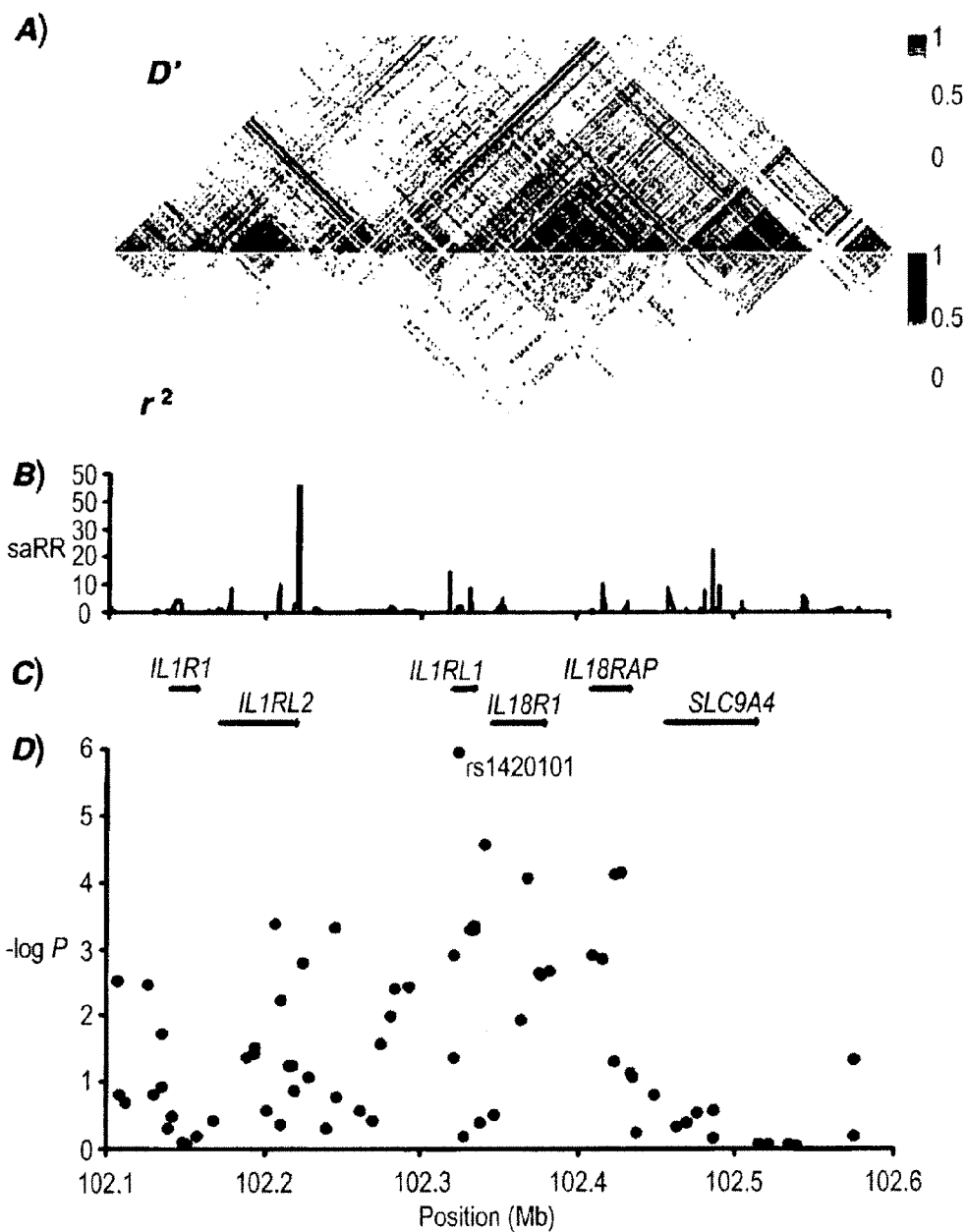

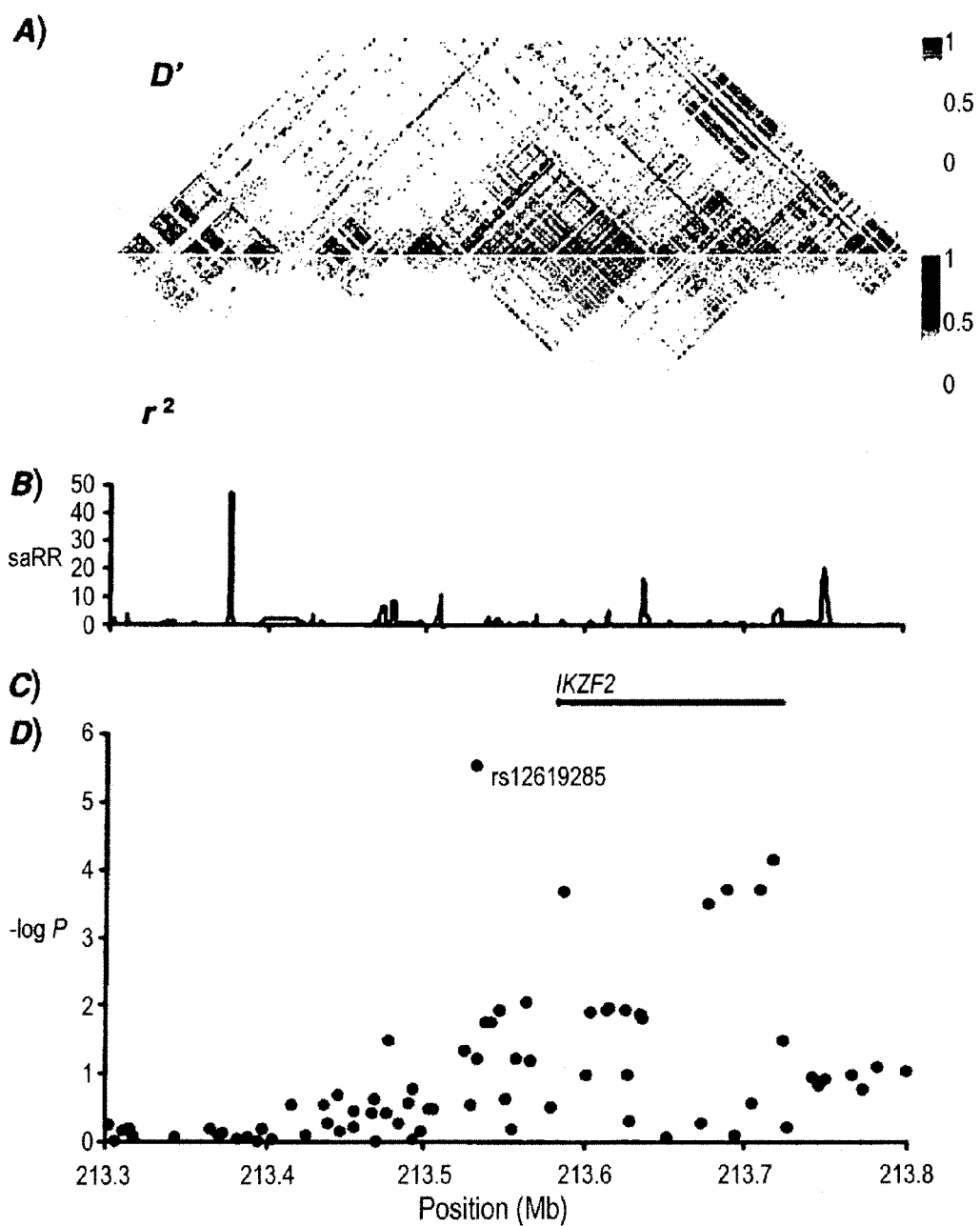

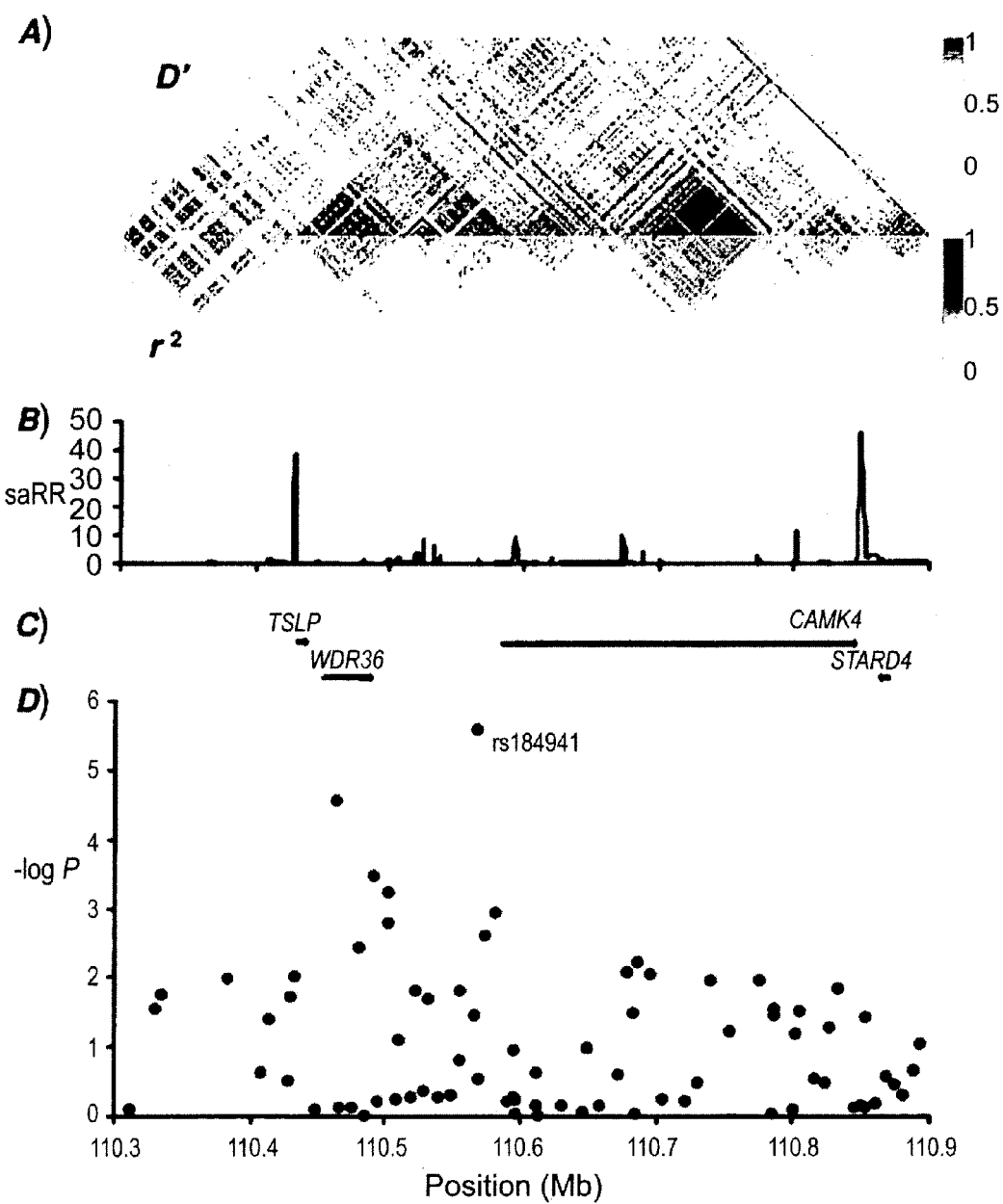

Chromosome 5q31

Chromosome 6p21

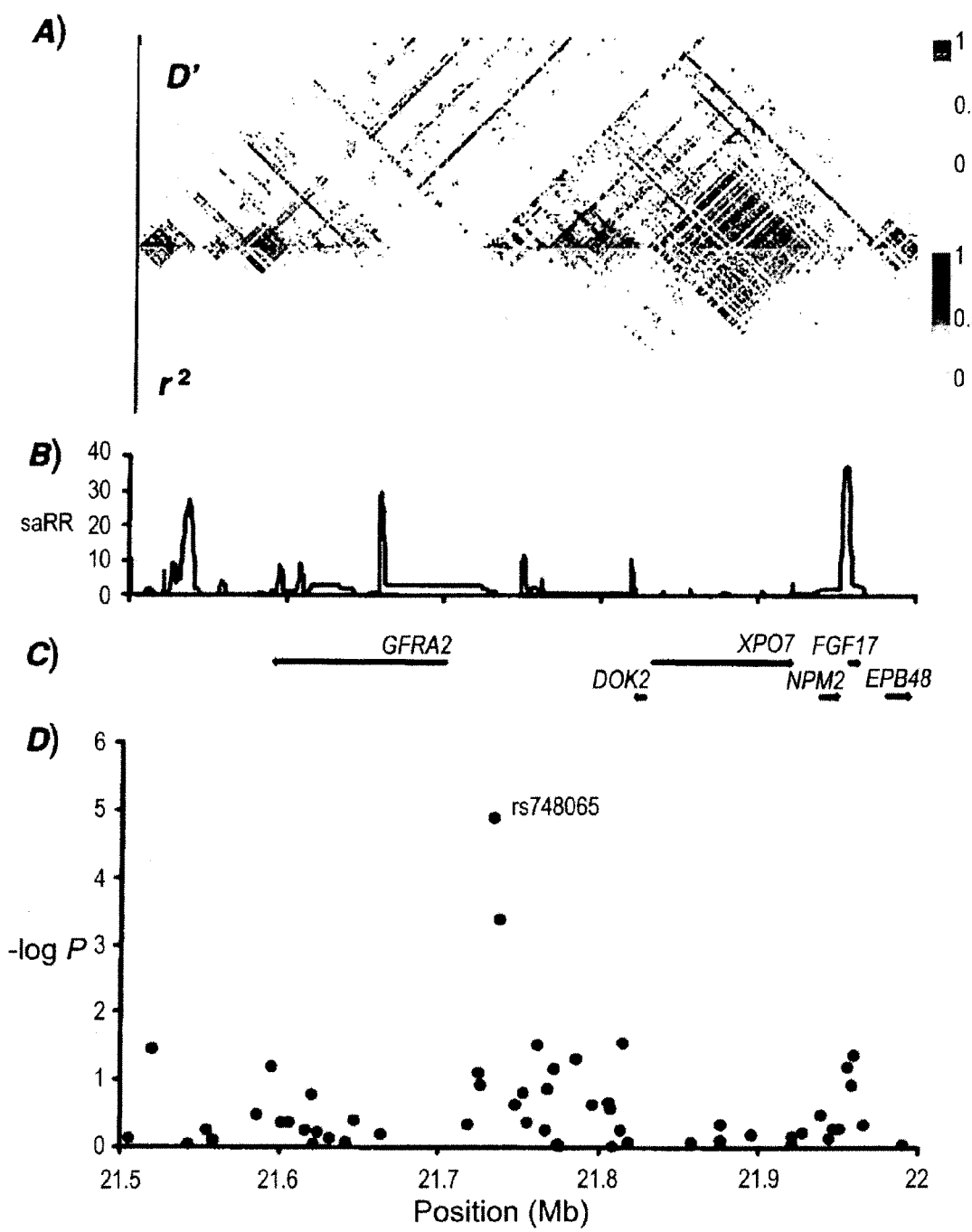

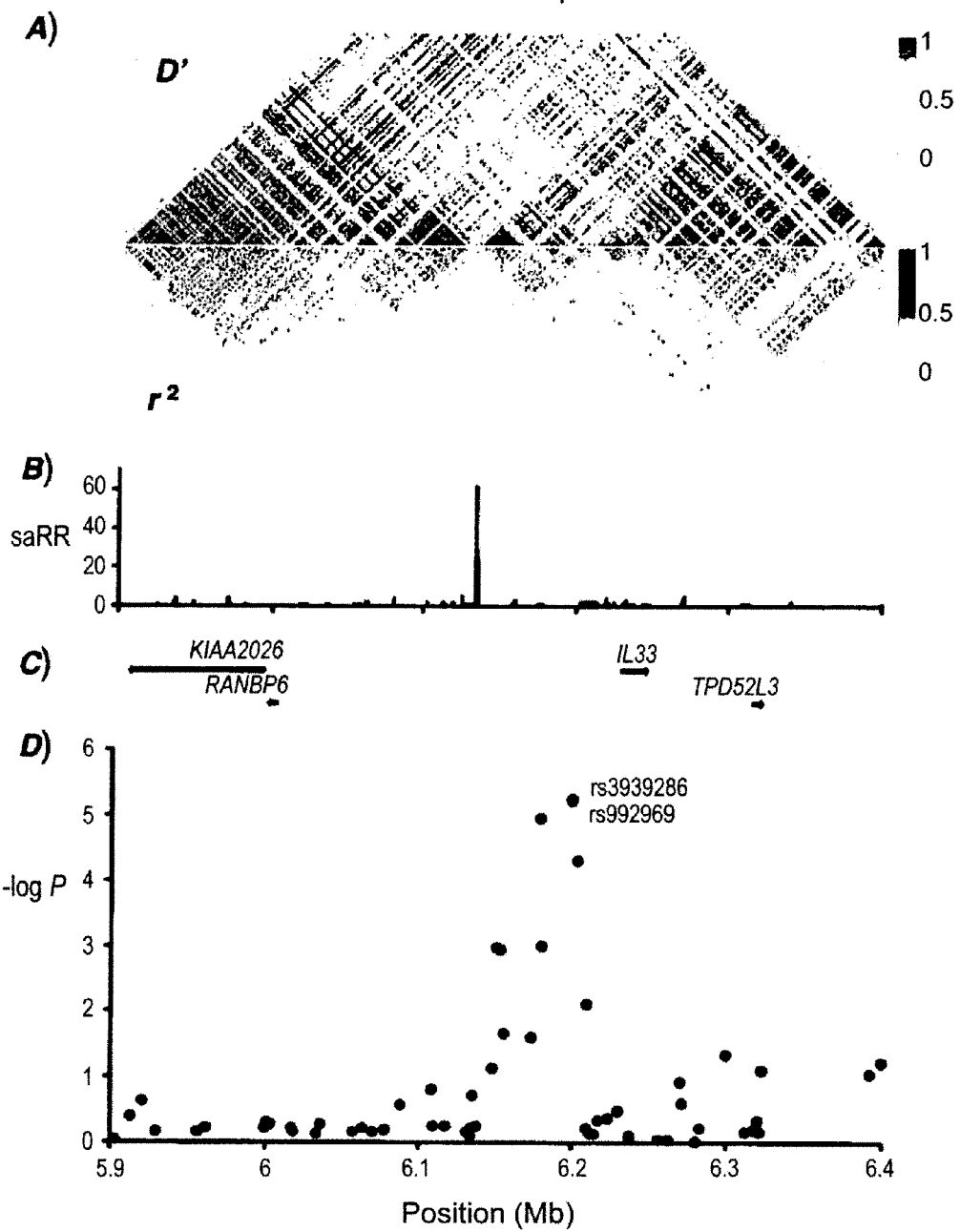

Chromosome 12q24

FIGURE 7

| SNP | SEQ ID NO: | SNP | SEQ ID NO: | SNP | SEQ ID NO: | SNP | SEQ ID NO: |
|---|---|---|---|---|---|---|---|
| rs12617902 | 1 | rs10200410 | 42 | rs6543119 | 83 | rs4851570 | 124 |
| rs4672665 | 2 | rs1345301 | 43 | rs13017455 | 84 | rs6749014 | 125 |
| rs16849446 | 3 | rs2310243 | 44 | rs17027006 | 85 | rs1420097 | 126 |
| rs975381 | 4 | rs13405355 | 45 | rs12469506 | 86 | rs4851004 | 127 |
| rs2170572 | 5 | rs12475055 | 46 | rs1921622 | 87 | rs2287034 | 128 |
| rs7560454 | 6 | rs11693697 | 47 | rs1861245 | 88 | rs2287033 | 129 |
| rs12619285 | 7 | rs4399750 | 48 | rs13424006 | 89 | rs4851005 | 130 |
| rs10189498 | 8 | rs4090473 | 49 | rs6751967 | 90 | rs1135354 | 131 |
| rs6750754 | 9 | rs11685424 | 50 | rs6749114 | 91 | rs1420094 | 132 |
| rs6740906 | 10 | rs1558622 | 51 | rs11123923 | 92 | rs17027087 | 133 |
| rs1482577 | 11 | rs10189711 | 52 | rs4988955 | 93 | rs6710528 | 134 |
| rs13022407 | 12 | rs12712135 | 53 | rs4988956 | 94 | rs3732124 | 135 |
| rs10199053 | 13 | rs953934 | 54 | rs4988957 | 95 | rs3732123 | 136 |
| rs17276404 | 14 | rs950880 | 55 | rs10204137 | 96 | rs4851571 | 137 |
| rs7588793 | 15 | rs11123918 | 56 | rs4988958 | 97 | rs4851572 | 138 |
| rs12616485 | 16 | rs10182639 | 57 | rs10192157 | 98 | rs2110662 | 139 |
| rs12613560 | 17 | rs11690443 | 58 | rs10206753 | 99 | rs7594402 | 140 |
| rs4467215 | 18 | rs974389 | 59 | rs7603730 | 100 | rs6710034 | 141 |
| rs2371786 | 19 | rs4142132 | 60 | rs12998521 | 101 | rs10203558 | 142 |
| rs10932456 | 20 | rs13001325 | 61 | rs10170583 | 102 | rs10200952 | 143 |
| rs4233991 | 21 | rs1420088 | 62 | rs10176664 | 103 | rs7559566 | 144 |
| rs7569831 | 22 | rs11123920 | 63 | rs3755276 | 104 | rs11693955 | 145 |
| rs7573040 | 23 | rs6706844 | 64 | rs2287037 | 105 | rs1592458 | 146 |
| rs12470672 | 24 | rs12996772 | 65 | rs1362348 | 106 | rs1420105 | 147 |
| rs13405747 | 25 | rs1420102 | 66 | rs3771172 | 107 | rs2293224 | 148 |
| rs7576646 | 26 | rs12466380 | 67 | rs3771171 | 108 | rs2293225 | 149 |
| rs7576850 | 27 | rs12479210 | 68 | rs2160202 | 109 | rs6743516 | 150 |
| rs7603237 | 28 | rs13019081 | 69 | rs3771166 | 110 | rs3771156 | 151 |
| rs7603346 | 29 | rs1997467 | 70 | rs1974675 | 111 | rs1420100 | 152 |
| rs7577413 | 30 | rs1997466 | 71 | rs10439410 | 112 | rs3771155 | 153 |
| rs6734978 | 31 | rs1362350 | 72 | rs6758936 | 113 | rs10206291 | 154 |
| rs4673714 | 32 | rs1362349 | 73 | rs2041739 | 114 | rs885088 | 155 |
| rs12620781 | 33 | rs17026974 | 74 | rs17027037 | 115 | rs3771154 | 156 |
| rs16849550 | 34 | rs12712141 | 75 | rs2080289 | 116 | rs6759479 | 157 |
| rs1871946 | 35 | rs873022 | 76 | rs10208196 | 117 | rs887972 | 158 |
| rs10932460 | 36 | rs3771177 | 77 | rs11683700 | 118 | rs887971 | 159 |
| rs13417169 | 37 | rs3732129 | 78 | rs3213732 | 119 | rs3755266 | 160 |
| rs12612034 | 38 | rs1420101 | 79 | rs6760621 | 120 | rs7559845 | 161 |
| rs1922291 | 39 | rs12905 | 80 | rs1035130 | 121 | rs2310300 | 162 |
| rs6743219 | 40 | rs3821204 | 81 | rs2241116 | 122 | rs11681718 | 163 |
| rs10167431 | 41 | rs12712142 | 82 | rs6706002 | 123 | rs4851582 | 164 |

FIGURE 7A

| SNP | SEQ ID NO: | SNP | SEQ ID NO: | SNP | SEQ ID NO: | SNP | SEQ ID NO: |
|---|---|---|---|---|---|---|---|
| rs3755265 | 165 | rs4857855 | 206 | rs1379300 | 247 | rs7720082 | 288 |
| rs4479442 | 166 | rs4075158 | 207 | rs2034896 | 248 | rs10073900 | 289 |
| rs2058659 | 167 | rs7635061 | 208 | rs10056179 | 249 | rs10060762 | 290 |
| rs17027166 | 168 | rs4857907 | 209 | rs10038058 | 250 | rs1428644 | 291 |
| rs13021177 | 169 | rs2335050 | 210 | rs10039043 | 251 | rs6892420 | 292 |
| rs10490204 | 170 | rs12494136 | 211 | rs2112541 | 252 | rs11959067 | 293 |
| rs17027179 | 171 | rs8180032 | 212 | rs10060003 | 253 | rs10063014 | 294 |
| rs10490203 | 172 | rs8179973 | 213 | rs10055177 | 254 | rs1072056 | 295 |
| rs3771150 | 173 | rs8179974 | 214 | rs10051830 | 255 | rs10040556 | 296 |
| rs11694360 | 174 | rs6782023 | 215 | rs11949868 | 256 | rs9326828 | 297 |
| rs11123928 | 175 | rs6806253 | 216 | rs17624563 | 257 | rs17460372 | 298 |
| rs7597017 | 176 | rs2734040 | 217 | rs2290680 | 258 | rs4957929 | 299 |
| rs6543135 | 177 | rs17344939 | 218 | rs7702774 | 259 | rs436398 | 300 |
| rs11465730 | 178 | rs2713589 | 219 | rs11951907 | 260 | rs244517 | 301 |
| rs11690532 | 179 | rs2734046 | 220 | rs11948089 | 261 | rs12518040 | 302 |
| rs6705385 | 180 | rs2465354 | 221 | rs6869774 | 262 | rs10477464 | 303 |
| rs6705498 | 181 | rs4328821 | 222 | rs6870356 | 263 | rs184941 | 304 |
| rs6719196 | 182 | rs2811493 | 223 | rs1438671 | 264 | rs1469441 | 305 |
| rs17027230 | 183 | rs6793907 | 224 | rs7731821 | 265 | rs919334 | 306 |
| rs12463588 | 184 | rs6768737 | 225 | rs6876020 | 266 | rs162892 | 307 |
| rs2310302 | 185 | rs6785206 | 226 | rs7714869 | 267 | rs270607 | 308 |
| rs12469887 | 186 | rs1545169 | 227 | rs1037684 | 268 | rs270606 | 309 |
| rs4140786 | 187 | rs764916 | 228 | rs390047 | 269 | rs156322 | 310 |
| rs10201184 | 188 | rs10061842 | 229 | rs10478039 | 270 | rs270601 | 311 |
| rs4851011 | 189 | rs4304115 | 230 | rs11745646 | 271 | rs273916 | 312 |
| rs17027255 | 190 | rs17551370 | 231 | rs9326826 | 272 | rs273915 | 313 |
| rs17027258 | 191 | rs10062929 | 232 | rs17459203 | 273 | rs273912 | 314 |
| rs17775170 | 192 | rs11466742 | 233 | rs6871704 | 274 | rs273911 | 315 |
| rs2335052 | 193 | rs11466749 | 234 | rs1821908 | 275 | rs272892 | 316 |
| rs13076142 | 194 | rs11466750 | 235 | rs6876720 | 276 | rs272888 | 317 |
| rs7433900 | 195 | rs7713025 | 236 | rs10039800 | 277 | rs272887 | 318 |
| rs4613470 | 196 | rs7723819 | 237 | rs10045416 | 278 | rs272883 | 319 |
| rs9819395 | 197 | rs7729832 | 238 | rs11241104 | 279 | rs272882 | 320 |
| rs9819402 | 198 | rs1370964 | 239 | rs11241105 | 280 | rs272880 | 321 |
| rs6803892 | 199 | rs1993465 | 240 | rs10900667 | 281 | rs272878 | 322 |
| rs7629705 | 200 | rs13357747 | 241 | rs10900668 | 282 | rs272872 | 323 |
| rs12490685 | 201 | rs7705304 | 242 | rs11241107 | 283 | rs272868 | 324 |
| rs6439132 | 202 | rs2416257 | 243 | rs10080189 | 284 | rs273901 | 325 |
| rs4431128 | 203 | rs10038177 | 244 | rs6888381 | 285 | rs2631372 | 326 |
| rs13098445 | 204 | rs10045255 | 245 | rs10054378 | 286 | rs2631362 | 327 |
| rs9854612 | 205 | rs10065045 | 246 | rs10062374 | 287 | rs671473 | 328 |

FIGURE 7B

| SNP | SEQ ID NO: | SNP | SEQ ID NO: | SNP | SEQ ID NO: | SNP | SEQ ID NO: |
|---|---|---|---|---|---|---|---|
| rs183898 | 329 | rs17166050 | 370 | rs3130481 | 411 | rs9267803 | 452 |
| rs17771891 | 330 | rs2522403 | 371 | rs614549 | 412 | rs4713505 | 453 |
| rs1016988 | 331 | rs2246176 | 372 | rs2736428 | 413 | rs4713506 | 454 |
| rs7704457 | 332 | rs2252775 | 373 | rs2844458 | 414 | rs1053924 | 455 |
| rs1003533 | 333 | rs10463893 | 374 | rs7887 | 415 | rs3134950 | 456 |
| rs1981524 | 334 | rs2897443 | 375 | rs2763982 | 416 | rs2269424 | 457 |
| rs10900807 | 335 | rs17622991 | 376 | rs644045 | 417 | rs1061808 | 458 |
| rs2106854 | 336 | rs2706370 | 377 | rs2734335 | 418 | rs1061807 | 459 |
| rs6874639 | 337 | rs2706372 | 378 | rs3020644 | 419 | rs2269423 | 460 |
| rs7730247 | 338 | rs6884762 | 379 | rs537160 | 420 | rs1035798 | 461 |
| rs1012793 | 339 | rs12187537 | 380 | rs4151657 | 421 | rs1800624 | 462 |
| rs2706383 | 340 | rs2522394 | 381 | rs2072633 | 422 | rs2071280 | 463 |
| rs2405528 | 341 | rs10520114 | 382 | rs2072632 | 423 | rs2071279 | 464 |
| rs886286 | 342 | rs2301713 | 383 | rs630379 | 424 | rs9267820 | 465 |
| rs757105 | 343 | rs6596086 | 384 | rs440454 | 425 | rs9267821 | 466 |
| rs2522047 | 344 | rs2106984 | 385 | rs2280774 | 426 | rs2071287 | 467 |
| rs2522050 | 345 | rs7449456 | 386 | rs419788 | 427 | rs2071277 | 468 |
| rs2706395 | 346 | rs3798135 | 387 | rs437179 | 428 | rs9267833 | 469 |
| rs2522054 | 347 | rs3798134 | 388 | rs592229 | 429 | rs2071286 | 470 |
| rs2706339 | 348 | rs6596087 | 389 | rs410851 | 430 | rs3134799 | 471 |
| rs2522056 | 349 | rs6871536 | 390 | rs6941112 | 431 | rs3134798 | 472 |
| rs2706373 | 350 | rs12653750 | 391 | rs389883 | 432 | rs436388 | 473 |
| rs2522062 | 351 | rs2040703 | 392 | rs6474 | 433 | rs444472 | 474 |
| rs2522063 | 352 | rs2040704 | 393 | rs12525076 | 434 | rs394657 | 475 |
| rs2706379 | 353 | rs2074369 | 394 | rs17421133 | 435 | rs429853 | 476 |
| rs2522064 | 354 | rs7737470 | 395 | rs1009382 | 436 | rs431722 | 477 |
| rs2057655 | 355 | rs2240032 | 396 | rs12198173 | 437 | rs430916 | 478 |
| rs2706381 | 356 | rs2158177 | 397 | rs2239689 | 438 | rs423023 | 479 |
| rs4705952 | 357 | rs3091307 | 398 | rs204883 | 439 | rs422951 | 480 |
| rs2706390 | 358 | rs2844477 | 399 | rs7766862 | 440 | rs520803 | 481 |
| rs4143832 | 359 | rs2857697 | 400 | rs2071295 | 441 | rs520692 | 482 |
| rs763595 | 360 | rs2857694 | 401 | rs12211410 | 442 | rs415929 | 483 |
| rs2079103 | 361 | rs2857693 | 402 | rs185819 | 443 | rs45855 | 484 |
| rs17690122 | 362 | rs2844472 | 403 | rs2071293 | 444 | rs7772031 | 485 |
| rs743562 | 363 | rs2736172 | 404 | rs17421624 | 445 | rs7754722 | 486 |
| rs12652920 | 364 | rs2260000 | 405 | rs13199524 | 446 | rs11758774 | 487 |
| rs2706338 | 365 | rs2736171 | 406 | rs12153855 | 447 | rs1547247 | 488 |
| rs2244012 | 366 | rs2736155 | 407 | rs429150 | 448 | rs9376090 | 489 |
| rs2299015 | 367 | rs1077393 | 408 | rs2269426 | 449 | rs7775698 | 490 |
| rs2706347 | 368 | rs1052486 | 409 | rs8111 | 450 | rs7776054 | 491 |
| rs2706348 | 369 | rs494620 | 410 | rs9391734 | 451 | rs9399137 | 492 |

FIGURE 7C

| SNP | SEQ ID NO: | SNP | SEQ ID NO: | SNP | SEQ ID NO: | SNP | SEQ ID NO: |
|---|---|---|---|---|---|---|---|
| rs9389268 | 493 | rs10107278 | 534 | rs4742211 | 575 | rs2283358 | 616 |
| rs11759553 | 494 | rs922504 | 535 | rs2106409 | 576 | rs7296313 | 617 |
| rs9373124 | 495 | rs4872494 | 536 | rs4766521 | 577 | rs2239195 | 618 |
| rs4895440 | 496 | rs4872500 | 537 | rs3919447 | 578 | rs2238154 | 619 |
| rs4895441 | 497 | rs17060602 | 538 | rs4766522 | 579 | rs3184504 | 620 |
| rs9376092 | 498 | rs7464201 | 539 | rs2106407 | 580 | rs739496 | 621 |
| rs9389269 | 499 | rs369756 | 540 | rs2106406 | 581 | rs10849949 | 622 |
| rs9402686 | 500 | rs450108 | 541 | rs12425190 | 582 | rs2073950 | 623 |
| rs10484494 | 501 | rs1116795 | 542 | rs2339706 | 583 | rs2301622 | 624 |
| rs6920211 | 502 | rs2225537 | 543 | rs4509829 | 584 | rs2301621 | 625 |
| rs11154 | 503 | rs10124250 | 544 | rs11838131 | 585 | rs4766578 | 626 |
| rs9494145 | 504 | rs10119713 | 545 | rs12818548 | 586 | rs10774625 | 627 |
| rs7766963 | 505 | rs2079 | 546 | rs4766523 | 587 | rs2339816 | 628 |
| rs9483788 | 506 | rs2381413 | 547 | rs4766524 | 588 | rs1029388 | 629 |
| rs2026937 | 507 | rs7032572 | 548 | rs7961663 | 589 | rs6490162 | 630 |
| rs6934903 | 508 | rs10815362 | 549 | rs7961935 | 590 | rs628825 | 631 |
| rs6569992 | 509 | rs2890704 | 550 | rs7978821 | 591 | rs630512 | 632 |
| rs9389272 | 510 | rs1929996 | 551 | rs4766526 | 592 | rs688812 | 633 |
| rs17064262 | 511 | rs10758748 | 552 | rs4766442 | 593 | rs657197 | 634 |
| rs6924687 | 512 | rs4742166 | 553 | rs4766443 | 594 | rs607316 | 635 |
| rs9494154 | 513 | rs1412426 | 554 | rs12815195 | 595 | rs616668 | 636 |
| rs17706858 | 514 | rs1412425 | 555 | rs4766527 | 596 | rs648997 | 637 |
| rs7757054 | 515 | rs1342326 | 556 | rs12814105 | 597 | rs625093 | 638 |
| rs11965277 | 516 | rs2095044 | 557 | rs991817 | 598 | rs638791 | 639 |
| rs1022506 | 517 | rs2381416 | 558 | rs11065784 | 599 | rs593226 | 640 |
| rs11154794 | 518 | rs10815370 | 559 | rs7968960 | 600 | rs616559 | 641 |
| rs12663543 | 519 | rs1888909 | 560 | rs4378452 | 601 | rs616513 | 642 |
| rs12660713 | 520 | rs2150970 | 561 | rs10774613 | 602 | rs653178 | 643 |
| rs6920829 | 521 | rs7046661 | 562 | rs1265566 | 603 | rs12369009 | 644 |
| rs3752383 | 522 | rs992969 | 563 | rs7970490 | 604 | rs695871 | 645 |
| rs6936293 | 523 | rs3939286 | 564 | rs3847953 | 605 | rs11065987 | 646 |
| rs7738267 | 524 | rs928413 | 565 | rs6490055 | 606 | rs601663 | 647 |
| rs10095228 | 525 | rs7848215 | 566 | rs11065884 | 607 | rs2238151 | 648 |
| rs17427894 | 526 | rs2066362 | 567 | rs10849944 | 608 | rs10744777 | 649 |
| rs10096540 | 527 | rs12339348 | 568 | rs7302763 | 609 | rs11679137 | 650 |
| rs17060577 | 528 | rs17582919 | 569 | rs10849946 | 610 | rs1370631 | 651 |
| rs17615281 | 529 | rs10975507 | 570 | rs4766573 | 611 | rs2164850 | 652 |
| rs10107501 | 530 | rs17498196 | 571 | rs10774623 | 612 | rs4851400 | 653 |
| rs17060585 | 531 | rs10815393 | 572 | rs12580300 | 613 | rs2165427 | 654 |
| rs748065 | 532 | rs7019575 | 573 | rs11065898 | 614 | rs4851411 | 655 |
| rs7014068 | 533 | rs744567 | 574 | rs10849947 | 615 | rs1559930 | 656 |

FIGURE 7D

| SNP | SEQ ID NO: | SNP | SEQ ID NO: | SNP | SEQ ID NO: | SNP | SEQ ID NO: |
|---|---|---|---|---|---|---|---|
| rs6730424 | 657 | | | | | | |
| rs2532072 | 658 | | | | | | |
| rs4629469 | 659 | | | | | | |
| rs11950562 | 660 | | | | | | |
| rs272893 | 661 | | | | | | |
| rs1050152 | 662 | | | | | | |
| rs2188962 | 663 | | | | | | |
| rs273148 | 664 | | | | | | |
| rs11778166 | 665 | | | | | | |
| rs2663041 | 666 | | | | | | |
| rs12411706 | 667 | | | | | | |
| rs11066320 | 668 | | | | | | |
| rs233722 | 669 | | | | | | |
| rs233716 | 670 | | | | | | |
| rs7315519 | 671 | | | | | | |
| rs4773225 | 672 | | | | | | |
| rs7150454 | 673 | | | | | | |
| rs927220 | 674 | | | | | | |
| rs6503609 | 675 | | | | | | |
| rs7223150 | 676 | | | | | | |
| rs9954643 | 677 | | | | | | |
| rs231228 | 678 | | | | | | |
| rs1805419 | 679 | | | | | | |
| rs1467412 | 680 | | | | | | |
| rs2426358 | 681 | | | | | | |

GENETIC VARIANTS AS MARKERS FOR USE IN DIAGNOSIS, PROGNOSIS AND TREATMENT OF EOSINOPHILIA, ASTHMA, AND MYOCARDIAL INFARCTION

CROSS-REFERENCE TO RELATED APPLICATIONS

This patent application claims the benefit of U.S. Provisional Patent Application No. 61/122,267, filed Dec. 12, 2008, which is incorporated by reference in its entirety.

BACKGROUND OF THE INVENTION

Eosinophils are pleiotropic multifunctional leukocytes involved in initiation and propagation of diverse inflammatory responses, as well as modulators of innate and adaptive immunity. They represent a small percentage of the total white blood cell population and are recruited from the bone marrow into the circulation to inflammatory foci and activated by various cytokines, chemokines and adhesion molecules (Hogan et al., Clin. Exp. Allergy 38: 709-750 (2008)). Activated eosinophils release toxic compounds from their granules and secrete inflammatory and regulatory cytokines, chemokines, and growth factors, including many potent inducers of immune responses in asthma, eczema, rhinitis, and other inflammatory diseases (Hogan et al., 2008, supra). Eosinophils are a major component of the inflammatory response observed in asthma and they are often the dominant inflammatory cell present in the bronchi of asthmatics (Lee et al., Science 305: 1773-1776 (2004)).

Eosinophilia, or abnormally high eosinophil counts in the blood or body tissue, can be caused by conditions or diseases including, eczema, leukemia, autoimmune diseases, asthma, allergic rhinitis (hay fever), and parasitic infection, as well as certain side effects of drugs. Without treatment, high numbers of eosinophils can accumulate in the heart and other organs, which can lead to nerve damage, heart failure, lung disease, and blood clots.

While methods of treating eosinophilia and conditions causative of eosinophilia are known in the art, there remains a need for methods of determining a susceptibility to such conditions.

SUMMARY OF THE INVENTION

The present application provides materials and methods for determining a susceptibility to eosinophilia and to conditions causative of, related to, or associated with eosinophilia. These and numerous other benefits will be apparent from the description that follows.

One aspect of the invention is a method of determining a susceptibility to eosinophilia in a human individual. In a specific embodiment, the method comprises obtaining sequence data about a human individual identifying at least one allele of at least one polymorphic marker associated with at least one gene selected from a group of genes specified herein, wherein different alleles of the at least one polymorphic marker are associated with different susceptibilities to eosinophilia in humans, and determining a susceptibility to eosinophilia from the sequence data.

In another specific embodiment, the method comprises obtaining sequence data about a human individual identifying at least one allele of at least one polymorphic marker selected from a group of polymorphic markers further described herein, and markers in linkage disequilibrium therewith, wherein different alleles of the at least one polymorphic marker are associated with different susceptibilities to eosinophilia in humans, and determining a susceptibility to eosinophilia from the sequence data.

Another aspect of the invention is a method of determining a susceptibility to asthma in a human individual. In a specific aspect, the method comprises obtaining sequence data about a human individual identifying at least one allele of at least one polymorphic marker associated with at least one of the IL1RL1 gene, the IL33 gene, and the WDR36 gene, wherein different alleles of the at least one polymorphic marker are associated with different susceptibilities to asthma in humans, and determining a susceptibility to asthma from the sequence data.

In another specific aspect, the method comprises obtaining sequence data about a human individual identifying at least one allele of at least one polymorphic marker selected from the group consisting of: rs1420101, rs3939286, rs2416257, and rs9494145, and markers in linkage disequilibrium therewith, wherein different alleles of the at least one polymorphic marker is associated with different susceptibilities to asthma in humans, and determining a susceptibility to asthma from the sequence data.

Yet another aspect of the invention is a method of determining a susceptibility to myocardial infarction in a human individual. In one specific embodiment, the method comprises obtaining sequence data about a human individual identifying at least one allele of at least one polymorphic marker associated with at least one of the SH2B3 gene, the ATXN2 gene, and the WDR36 gene, wherein different alleles of the at least one polymorphic marker are associated with different susceptibilities to myocardial infarction in humans, and determining a susceptibility to myocardial infarction from the sequence data.

In another specific embodiment, the method comprises obtaining sequence data about a human individual identifying at least one polymorphic marker selected from the group consisting of: rs3184504 and rs653178, and markers in linkage disequilibrium therewith, wherein different alleles of the at least one polymorphic marker are associated with different susceptibilities to myocardial infarction in humans, and determining a susceptibility to myocardial infarction from the sequence data.

One aspect of the invention is a method of determining a susceptibility to hypertension in a human individual. In one specific embodiment, the method comprises obtaining sequence data about a human individual identifying at least one allele of at least one polymorphic marker associated with at least one of the SH2B3 gene, wherein different alleles of the at least one polymorphic marker are associated with different susceptibilities to hypertension in humans, and determining a susceptibility to hypertension from the sequence data.

In another specific embodiment, the method comprises obtaining sequence data about a human individual identifying at least one polymorphic marker selected from the group consisting of: rs3184504 and markers in linkage disequilibrium therewith, wherein different alleles of the at least one polymorphic marker are associated with different susceptibilities to hypertension in humans, and determining a susceptibility to hypertension from the sequence data.

Related aspects of the invention include a screening method, genotyping methods, and prognostic methods. For example, the invention includes a method of screening a candidate marker for assessing susceptibility to a condition causative of or correlative with eosinophilia. The method comprises analyzing the frequency of at least one allele of a polymorphic marker of a group further described herein in a population of human individuals diagnosed with the condition, wherein a significant difference in frequency of the at least one allele in the population of human individuals diagnosed with the condition as compared to the frequency of the at least one allele in a control population of human individuals is indicative of the allele as a marker of the condition.

The invention also includes methods of genotyping a nucleic acid sample obtained from a human individual at risk for, or diagnosed with, eosinophilia, asthma, myocardial infarction, or hypertension comprising determining the identity of at least one allele of at least one polymorphic marker in the sample, wherein the marker is one which associates with eosinophilia, asthma, myocardial infarction, or hypertension as described herein, or is a marker in linkage disequilibrium therewith. With regard to the inventive genotyping methods presented herein, it should be appreciated that the methods do not provide the identification of a number of alleles such that the entire genome of the human individual is genotyped. Rather, the inventive methods provide the identification of a number, e.g., 100 or less, of alleles of the human individual.

Also included are methods of predicting prognosis of an individual experiencing symptoms associated with, or an individual diagnosed with, eosinophilia, asthma, myocardial infarction, or hypertension. Each of the methods comprises obtaining nucleic acid sequence data about a human individual identifying at least one allele of at least one polymorphic marker associated with eosinophilia, asthma, myocardial infarction, or hypertension, as further described herein, wherein different alleles of the at least one polymorphic marker are associated with different susceptibilities to eosinophilia, asthma, myocardial infarction or hypertension in humans, and predicting prognosis of the individual from the nucleic acid sequence data.

Further included are methods of assessing an individual for probability of a response to a therapeutic agent for preventing, treating, and/or ameliorating symptoms associated with eosinophilia, asthma, myocardial infarction, or hypertension. Each of the methods comprises determining the identity of at least one allele of at least one polymorphic marker in a nucleic acid sample obtained from the individual, wherein the at least one polymorphic marker is one which associates with eosinophilia, asthma, myocardial infarction, or hypertension, as further described herein, wherein the identity of the at least one allele of the at least one polymorphic marker is indicative of a probability of a positive response to the therapeutic agent.

Other related aspects of the invention include materials for assessing susceptibility to eosinophilia, asthma, or myocardial infarction of a human individual. For example, the invention includes kits for assessing susceptibility of a human individual to eosinophilia, asthma, myocardial infarction, or hypertension. Each of the kits comprises reagents for selectively detecting at least one allele of at least one polymorphic marker of a group as described herein in the genome of the individual, and a collection of data comprising correlation data between the polymorphic markers and susceptibility to eosinophilia, asthma, myocardial infarction, or hypertension.

The invention also includes computer-readable medium having computer executable instructions for determining susceptibility to eosinophilia, asthma, myocardial infarction, or hypertension. Each of the computer-readable medium comprises data indicative of at least one polymorphic marker; a routine stored on the computer readable medium and adapted to be executed by a processor to determine risk of developing eosinophilia, asthma, myocardial infarction, or hypertension for the at least one polymorphic marker, wherein the at least one polymorphic marker is associated with a gene which associates with eosinophilia, asthma, myocardial infarction, or hypertension as further described herein.

The invention further includes apparatus for determining a genetic indicator for eosinophilia, asthma, myocardial infarction, or hypertension in a human individual. Each of the apparatus of the invention comprises a processor, a computer readable memory having computer executable instructions adapted to be executed on the processor to analyze marker and/or haplotype information for at least one human individual with respect to at least one polymorphic marker associated with a gene which associates with eosinophilia, asthma, myocardial infarction, or hypertension, as further described herein, and generate an output based on the marker or haplotype information, wherein the output comprises a measure susceptibility of the at least one marker or haplotype as a genetic indicator of eosinophilia, asthma, myocardial infarction, or hypertension for the human individual.

Furthermore, the invention provides uses of an oligonucleotide probe which hybridizes to a segment of a nucleic acid comprising a polymorphic marker which is indicative of a susceptibility to eosinophilia, asthma, myocardial infarction, and/or hypertension in the manufacture of a diagnostic reagent for diagnosing and/or assessing susceptibility to eosinophilia, asthma, myocardial infarction, and/or hypertension. In a specific embodiment, the segment comprises a polymorphism as described herein.

The invention moreover provides the use of an anti-eosinophilia agent, anti-asthma agent, anti-myocardial infarction agent, or anti-hypertension in the preparation of a medicament for treating eosinophilia, asthma, or myocardial infarction in a human that has been tested for (a) the presence of at least one allele of at least one polymorphic marker which associates with eosinophilia, asthma, or myocardial infarction, as described herein; and/or (b) the presence of an amino acid substitution in an amino acid sequence encoded by the polymorphic marker. In some variations, the human tests positive for the presence of at least one allele which associates with the condition(s).

Further provided herein are improved methods of determining the safety and/or efficacy of a therapeutic agent used to treat eosinophilia, asthma, myocardial infarction, or hypertension in a human individual. The method comprises obtaining sequence data about a human individual identifying at least one allele of at least one polymorphic marker selected from a group as described herein.

The invention moreover provides diagnostic methods of eosinophilia, asthma, or myocardial infarction. For example, the invention provides a method of diagnosing eosinophilia in a human individual comprising measuring the count of eosinophils in the blood of a human individual and obtaining sequence data identifying at least one allele of at least one polymorphic marker selected from a group of polymorphic markers described herein.

Also, for example, the invention provides a method of diagnosing asthma in a human individual, comprising (A) one or a combination of (i) considering symptoms experienced by the human individual and/or the family history of the human individual, (ii) physically examining the upper respiratory tract, chest, and skin of the human individual, and (iii) conducting a breathing test on the human individual, and (B) obtaining sequence data identifying at least one allele of at least one polymorphic marker selected from the group consisting of: rs1420101, rs3939286, rs2416257, and rs9494145, and markers in linkage disequilibrium therewith.

Further, the invention provides a method of diagnosing myocardial infarction in a human individual, comprising (A) one or a combination of (i) considering the history of an illness and the symptoms experienced by the human individual, (ii) physically examining the human individual, (iii) conducting one or a combination of an electrocardiogram, a coronary angiogram, chest radiograph, and echocardiogram on the human individual, (iv) testing blood of the human individual for cardiac markers, (v) detecting areas of reduced blood flow in conjunction with physiologic or pharmacologic stress, and (vi) determining the viability of tissue of the myocardium, and (B) obtaining sequence data identifying at least one allele of at least one polymorphic marker selected from the group consisting of: rs3184504 and rs653178, and markers in linkage disequilibrium therewith.

The original claims appended hereto are hereby incorporated by reference into the summary of the invention. Inventions described as uses should be considered to also constitute a description of methods or processes of using, and vice versa, in view of different jurisdictions' preferences for characterizing inventions differently.

The foregoing summary is not intended to define every aspect of the invention, and the heading "Summary of the Invention" is not intended to be limiting in any way; additional aspects of the invention and further details of the invention are described in other sections, such as the Drawing or Detailed Description. The entire document is intended to be related as a unified disclosure, and it should be understood that all combinations of features described herein are contemplated, even if the combination of features are not found together in the same sentence, or paragraph, or section of this document.

In addition to the foregoing, the invention includes, as an additional aspect, all embodiments of the invention narrower in scope in any way than the variations specifically mentioned above. Embodiments summarized in the Summary section are frequently further described, with preferred variations, in the Detailed Description, and these variations are part of the invention incorporated into the Summary by reference. With respect to aspects of the invention described as a genus (e.g., an anchor marker and markers in linkage disequilibrium with the anchor marker), all individual species (e.g., individual markers) are individually considered separate aspects of the invention. With respect to aspects of the invention that are described with reference to exemplary numerical values, it should be understood that such values are intended to describe ranges or sub-ranges that include the recited values. With respect to aspects described with numerical ranges, it should be understood that all subranges are contemplated.

Although the applicant(s) invented the full scope of the claims appended hereto, the claims appended hereto are not intended to encompass within their scope the prior art work of others. Therefore, in the event that statutory prior art within the scope of a claim is brought to the attention of the applicants by a Patent Office or other entity or individual, the applicant(s) reserve the right to exercise amendment rights under applicable patent laws to redefine the subject matter of such a claim to specifically exclude such statutory prior art or obvious variations of statutory prior art from the scope of such a claim. Variations of the invention defined by such amended claims also are intended as aspects of the invention. Additional features and variations of the invention will be apparent to those skilled in the art from the entirety of this application, and all such features are intended as aspects of the invention.

BRIEF DESCRIPTION OF THE DRAWINGS

FIGS. 4 and 4A-4I represent the pair-wise correlation structure in the indicated interval on the indicated chromosomal region. The upper plot shows pair-wise D' for n common SNPs (with MAF>5%) from the HapMap (v22) CEU dataset. The lower plot shows the corresponding $r^2$ values. FIG. 4.1A—500 kb interval: 102.1-102.6 Mb, NCBI B36; ch. 2q12; n=868; FIG. 4.2A—500 kb interval: 213.3-213.8 Mb, NCBI B36; ch. 2q34; n=508; FIG. 4.3A—500 kb interval: 129.5-130.0 Mb, NCBI B36; ch. 3q21; n=297; FIG. 4.4A—600 bp interval: 110.3-110.9 Mb, NCBI, B36; ch. 5q22; n=619; FIG. 4.5A—500 kb interval: 131.65-132.15 Mb, NCBI B36; ch. 5q31; n=441; FIG. 4.6A—500 kb interval: 32-32.5 Mb, NCBI B36; ch. 6p21; n=813; FIG. 4.7A—500 kb interval: 135.2-135.7 Mb, NCBI B36; ch. 6q23; n=464; FIG. 4.8A—500 kb interval: 21.5-22.0 Mb, NCBI B36; ch. 8p21; n=407; FIG. 4.9A—500 kb interval: 5.9-6.4 Mb; NCBI B36; ch. 9p24; n=495; FIG. 4.10A—2 Mb interval: 110-112 Mb, NCBI B36; ch. 12q24; n=955.

FIGS. 4.1B to 4.10B represent the estimated recombination rates (saRR) in cM/Mb from the HapMap Phase II data (Nature 449, 851-861 (18 Oct. 2007)) for the chromosomal region indicated in the corresponding A figure.

FIGS. 4.1C to 4.10C represent the location of known genes in the region of indicated in the corresponding A figure.

FIGS. 4.1D to 4.10D represent a schematic view of the association with variation in eosinophil counts for all SNPs tested in the region indicated in the corresponding A figure in the genome-wide Icelandic data.

FIGS. 7 and 7A-7D represent a table denoting the SEQ ID NO: of the nucleotide sequence comprising the referenced SNP.

DETAILED DESCRIPTION OF THE INVENTION

Definitions

Figure 1:
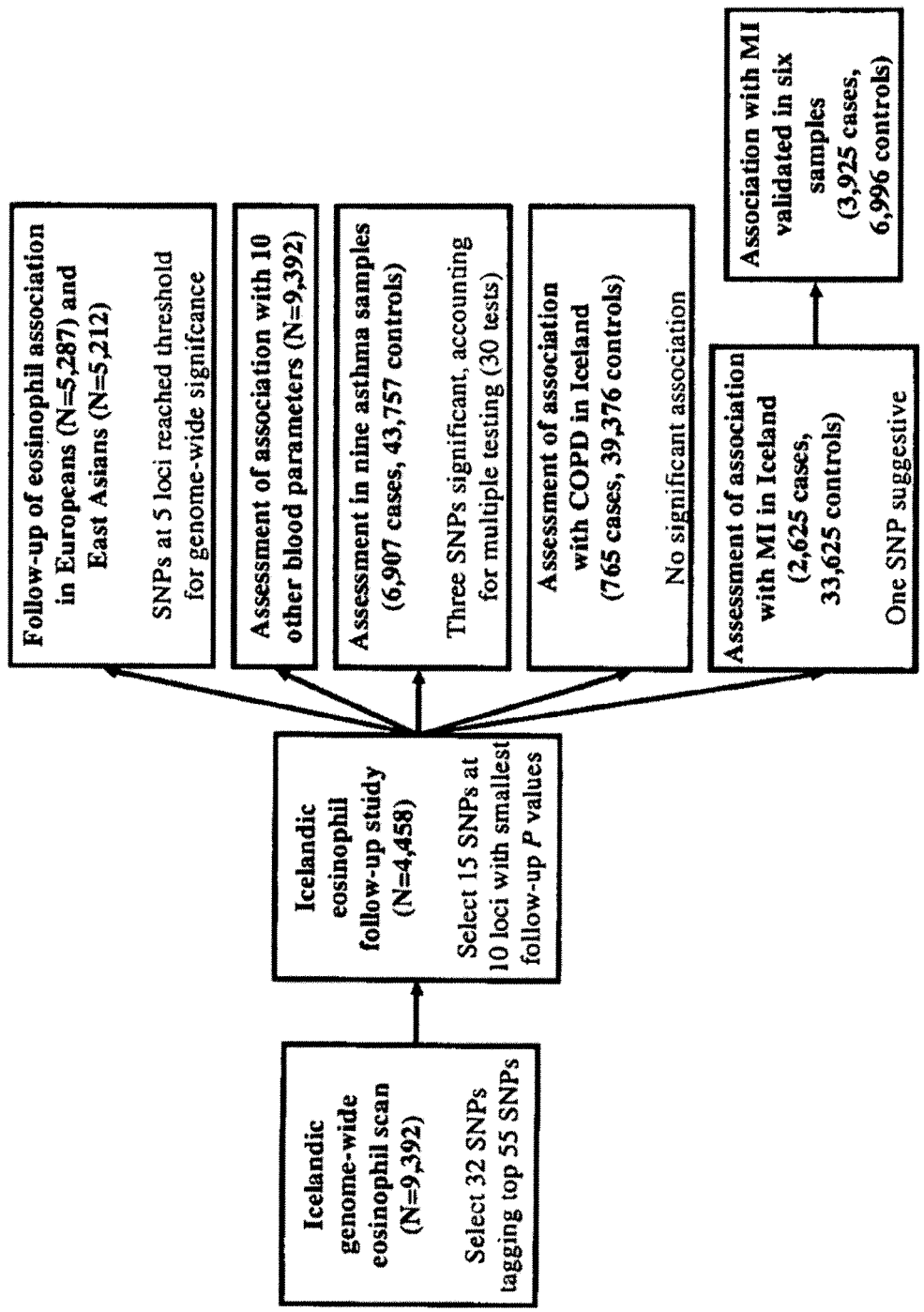
FIG. 1 represents an overview of the study design, implementation, and results

Unless otherwise indicated, nucleic acid sequences are written left to right in a 5' to 3' orientation. Numeric ranges recited within the specification are inclusive of the numbers defining the range and include each integer or any non-integer fraction within the defined range. Unless otherwise defined, all technical and scientific terms used herein have the same meaning as commonly understood by the ordinary person skilled in the art to which the invention pertains.

The following terms shall, in the present context, have the meaning as indicated:

A "polymorphic marker," sometimes referred to as a "marker," as described herein, refers to a genomic polymorphic site. Each polymorphic marker has at least two sequence variations characteristic of particular alleles at the polymorphic site. Thus, genetic association to a polymorphic marker implies that there is association to at least one specific allele of that particular polymorphic marker. The marker can comprise any allele of any variant type found in the genome, including single nucleotide polymorphisms (SNPs), mini- or microsatellites, translocations and copy number variations (insertions, deletions, duplications). Polymorphic markers can be of any measurable frequency in the population. For mapping of disease genes, polymorphic markers with population frequency higher than 5-10% are in general most useful. However, polymorphic markers may also have lower population frequencies, such as 1-5% frequency, or even lower frequency, in particular copy number variations (CNVs). The term shall, in the present context, be taken to include polymorphic markers with any population frequency.

An "allele" refers to the nucleotide sequence of a given locus (position) on a chromosome. A polymorphic marker allele thus refers to the composition (i.e., sequence) of the marker on a chromosome. Genomic DNA from an individual contains two alleles for any given polymorphic marker, representative of each copy of the marker on each chromosome. Sequence codes for nucleotides used herein are: A=1, C=2, G=3, T=4. Sequence co-nucleotide ambiguity as described herein and in the accompanying sequence listing is as proposed by IUPAC-IUB (Table 1).

TABLE 1

| IUB code | Meaning |
| --- | --- |
| A | Adenosine (A) |
| C | Cytidine (C) |
| G | Guanine (G) |
| T | Thymidine (T) |
| R | G or A |
| Y | T or C |
| K | G or T |
| M | A or C |
| S | G or C |
| W | A or T |
| B | C, G or T |
| D | A, G or T |
| H | A, C or T |
| V | A, C or G |
| N | A, C, G or T (Any base) |

For microsatellite alleles, the CEPH sample (Centre d'Etudes du Polymorphisme Humane, genomics repository, CEPH sample 1347-02) is used as a reference, the shorter allele of each microsatellite in this sample is set as 0 and all other alleles in other samples are numbered in relation to this reference. Thus, e.g., allele 1 is 1 bp longer than the shorter allele in the CEPH sample, allele 2 is 2 bp longer than the shorter allele in the CEPH sample, allele 3 is 3 bp longer than the lower allele in the CEPH sample, etc., and allele −1 is 1 bp shorter than the shorter allele in the CEPH sample, allele −2 is 2 bp shorter than the shorter allele in the CEPH sample, etc.

A nucleotide position at which more than one sequence is possible in a population (either a natural population or a synthetic population, e.g., a library of synthetic molecules) is referred to herein as a "polymorphic site".

A "Single Nucleotide Polymorphism" or "SNP" is a DNA sequence variation occurring when a single nucleotide at a specific location in the genome differs between members of a species or between paired chromosomes in an individual. Most SNP polymorphisms have two alleles. Each individual is in this instance either homozygous for one allele of the polymorphism (i.e., both chromosomal copies of the individual have the same nucleotide at the SNP location), or the individual is heterozygous (i.e., the two sister chromosomes of the individual contain different nucleotides). The SNP nomenclature as reported herein refers to the official Reference SNP (rs) ID identification tag as assigned to each unique SNP by the National Center for Biotechnological Information (NCBI).

A "variant", as described herein, refers to a segment of DNA that differs from the reference DNA. A "marker" or a "polymorphic marker", as defined herein, is a variant. Alleles that differ from the reference are referred to as "variant" alleles.

A "fragment" of a nucleotide or a protein, as described herein, comprises all or a part of the nucleotide or the protein.

An "animal", as described herein, refers to any domestic animal (e.g., cats, dogs, etc.), agricultural animal (e.g., cows, horses, sheep, chicken, etc.), or test species (e.g., rabbit, mouse, rat, etc.), and also includes humans.

A "microsatellite" is a polymorphic marker that has multiple small repeats of bases that are 2-8 nucleotides in length (such as CA repeats) at a particular site, in which the number of repeat lengths varies in the general population.

An "indel" is a common form of polymorphism comprising a small insertion or deletion that is typically only a few nucleotides long.

A "haplotype," as described herein, refers to a segment of genomic DNA within one strand of DNA that is characterized by a specific combination of alleles arranged along the segment. For diploid organisms such as humans, a haplotype comprises one member of the pair of alleles for each polymorphic marker or locus. In a certain embodiment, the haplotype can comprise two or more alleles, three or more alleles, four or more alleles, or five or more alleles. Haplotypes are described herein in the context of the marker name and the allele of the marker in that haplotype, e.g., "A rs1420101" refers to the A allele of marker rs1420101 being in the haplotype, and is equivalent to "rs1420101 allele A". Furthermore, allelic codes in haplotypes are as for individual markers, i.e. 1=A, 2=C, 3=G and 4=T.

The term "susceptibility", as described herein, encompasses both increased susceptibility and decreased susceptibility. Thus, particular polymorphic markers and/or haplotypes of the invention may be characteristic of increased susceptibility (i.e., increased risk) of eosinophilia, asthma, and/or myocardial infarction, as characterized by a relative risk (RR) of greater than one. Alternatively, the markers and/or haplotypes of the invention are characteristic of decreased susceptibility (i.e., decreased risk) of eosinophilia, asthma, and/or myocardial infarction, as characterized by a relative risk of less than one.

The term "and/or" shall in the present context be understood to indicate that either or both of the items connected by it are involved. In other words, the term herein shall be taken to mean "one or the other or both".

The term "look-up table", as described herein, is a table or data collection that correlates one form of data to another form, or one or more forms of data to a predicted outcome to which the data is relevant, such as phenotype or trait. For example, a look-up table can comprise a correlation between allelic data for at least one polymorphic marker and a particular trait or phenotype, such as a particular disease diagnosis, that an individual who comprises the particular allelic data is likely to display, or is more likely to display than individuals who do not comprise the particular allelic data. Look-up tables can be multidimensional, i.e., they can contain information about multiple alleles for single markers simultaneously, or the can contain information about multiple markers, and they may also comprise other factors, such as particulars about diseases diagnoses, racial information, biomarkers, biochemical measurements, therapeutic methods or drugs, etc.

A "computer-readable medium" is an information storage medium that can be accessed by a computer using a commercially available or custom-made interface. Exemplary compute-readable media include memory (e.g., RAM, ROM, flash memory, etc.), optical storage media (e.g., CD-ROM), magnetic storage media (e.g., computer hard drives, floppy disks, etc.), punch cards, or other commercially available media. Information may be transferred between a system of interest and a medium, between computers, or between computers and the computer-readable medium for storage or access of stored information. Such transmission can be electrical, or by other available methods, such as IR links, wireless connections, etc.

A "nucleic acid sample" is a sample obtained from an individual that contains nucleic acid (DNA or RNA). In certain embodiments, i.e. the detection of specific polymorphic markers and/or haplotypes, the nucleic acid sample comprises genomic DNA. Such a nucleic acid sample can be obtained from any source that contains genomic DNA, including as a blood sample, sample of amniotic fluid, sample of cerebrospinal fluid, or tissue sample from skin, muscle, buccal or conjunctival mucosa (buccal swab), placenta, gastrointestinal tract or other organs.

The term "polypeptide", as described herein, refers to a polymer of amino acids, and not to a specific length; thus, peptides, oligopeptides and proteins are included within the definition of a polypeptide.

The term "gene" as used herein refers to a locatable region of genomic sequence, corresponding to a unit of inheritance, which is associated with regulatory regions, transcribed regions, and/or other functional sequence regions.

The term "eosinophilia" as used herein refers to abnormally high eosinophil counts in the blood or body tissue. In most cases, the eosinophilia referenced herein means abnormally high eosinophil counts in the blood.

As used herein, the phrase "polymorphic marker associated with" used in reference to a gene, refers to a polymorphic marker which is found within or near the specified gene(s). The polymorphic marker associated with a gene can be found in an intron or exon of the gene. Alternatively, the polymorphic marker associated with a gene can be located in a transcriptional regulatory region of the gene, e.g., a promoter, enhancer, 3'UTR, 5' UTR of a gene, polyA tail, etc.

Through association analyses of populations of individuals found to have increased blood eosinophil counts, it is shown for the first time herein that certain variant alleles of certain polymorphic markers associate with high blood eosinophil counts. Because eosinophils play important roles in both asthma and myocardial infarction, subsequent studies described herein demonstrate that a subset of the variant alleles which associate with high blood eosinophil counts additionally associates with an increased risk of asthma or myocardial infarction. Without being bound to a particular theory, these variant alleles of the polymorphic markers described herein are contemplated as useful markers for determining susceptibility to eosinophilia and conditions causative of or correlated/associated with eosinophilia, such as asthma and myocardial infarction.

Methods of Determining Susceptibility to Eosinophilia

Accordingly, the invention provides methods of determining a susceptibility to eosinophilia in a human individual. In a specific embodiment, the method comprises obtaining sequence data about a human individual identifying at least one allele of at least one polymorphic marker selected from the group consisting of: rs1050152, rs11066320, rs11679137, rs11778166, rs11950562, rs12411706, rs9954643, rs12619285, rs1265566, rs12998521, rs1370631, rs1412426, rs1420101, rs1467412, rs1559930, rs1805419, rs184941, rs2079103, rs2164850, rs2165427, rs2188962, rs2244012, rs2269426, rs231228, rs2335050, rs233716, rs233722, rs2416257, rs2426358, rs2532072, rs2663041, rs272893, rs273148, rs2897443, rs3184504, rs3939286, rs4143832, rs4629469, rs4773225, rs4851400, rs4851411, rs4857855, rs6439132, rs6503609, rs653178, rs6730424, rs6871536, rs7150454, rs7223150, rs7315519, rs748065, rs7635061, rs927220, rs9494145, and rs992969, and markers in linkage disequilibrium therewith, which are the polymorphic markers listed in Table 3, and markers in linkage disequilibrium therewith, and haplotypes which comprise such markers, wherein different alleles of the at least one polymorphic marker (or different haplotypes) are associated with different susceptibilities to eosinophilia in humans, and determining a susceptibility to eosinophilia from the sequence data.

In a specific aspect of the invention, the at least one polymorphic marker is selected from the group consisting of: rs9954643, rs273148, rs3939286, rs1420101, rs11066320, rs4857855, rs9494145, rs2416257, rs2079103, rs2165427, rs3184504, rs2663041, rs1412426, rs11778166, rs4143832, rs653178, rs6730424, rs4629469, rs748065, rs11679137, rs2164850, rs12619285, rs2269426, rs7635061, rs184941, rs2532072, rs6503609, rs4773225, rs2426358, rs231228, rs7223150, and rs7150454, and markers in linkage disequilibrium therewith, which are the polymorphic markers listed in Table 4.

In yet another specific aspect of the invention, the at least one polymorphic marker is selected from the group consisting of: rs12619285, rs1412426, rs1420101, rs184941, rs2079103, rs2269426, rs2416257, rs3184504, rs3939286, rs4143832, rs4857855, rs653178, rs748065, rs7635061, and rs9494145, and markers in linkage disequilibrium therewith, which are the polymorphic markers shown in Tables 6 and 7. Alternatively, the at least one polymorphic marker is selected from the group consisting of: rs12619285, rs1420101, rs2269426, rs2416257, rs3184504, rs3939286, rs4143832, rs4857855, rs748065, and rs9494145, and markers in linkage disequilibrium therewith, which are the polymorphic markers listed in Table 6.

In a more specific aspect of the invention, the at least one polymorphic marker is selected from the group consisting of: rs12619285, rs1420101, rs3184504, rs4143832, rs4857855, and rs9494145, and markers in linkage disequilibrium therewith, which are the polymorphic markers that satisfy the criteria for genome wide significance as shown in Table 6.

In one aspect of the invention, the at least one allele can be one of: the C allele of rs1050152, the A allele of rs11066320, the G allele of rs11679137, the C allele of rs11778166, the A allele of rs11950562, the G allele of rs12411706, the G allele of rs9954643, the A allele of rs12619285, the T allele of rs1265566, the T allele of rs12998521, the A allele of rs1370631, the T allele of rs1412426, the A allele of rs1420101, the A allele of rs1467412, the A allele of rs1559930, the G allele of rs1805419, the G allele of rs184941, the T allele of rs2079103, the C allele of rs2164850, the A allele of rs2165427, the C allele of rs2188962, the C allele of rs2244012, the T allele of rs2269426, the C allele of rs231228, the C allele of rs2335050, the G allele of rs233716, the C allele of rs233722, the G allele of rs2416257, the C allele of rs2426358, the C allele of rs2532072, the T allele of rs2663041, the A allele of rs272893, the G allele of rs273148, the A allele of rs2897443, the T allele of rs3184504, the A allele of rs3939286, the A allele of rs4143832, the G allele of rs4629469, the G allele of rs4773225, the A allele of rs4851400, the T allele of rs4851411, the C allele of rs4857855, the T allele of rs6439132, the A allele of rs6503609, the G allele of rs653178, the T allele of rs6730424, the C allele of rs6871536, the G allele of rs7150454, the G allele of rs7223150, the A allele of rs7315519, the A allele of rs748065, the A allele of rs7635061, the C allele of rs927220, the T allele of rs9494145, and the A allele of rs992969, which are listed in Table 3.

Alternatively, the allele can be the allele of the complementary strand of DNA, such that the nucleic acid data includes the identification of at least one allele which is complementary to any of the alleles of the polymorphic markers referenced above.

Because some of the above referenced polymorphic markers are associated with and/or physically located within or near a particular gene (as shown in Table 3), it is believed that a susceptibility to eosinophilia can be determined based on nucleic acid or amino acid data of at least one of these genes. Accordingly, the invention provides a method of determining a susceptibility to eosinophilia in a human individual, the method comprises obtaining sequence data about a human individual identifying at least one allele of at least one polymorphic marker of at least one gene selected from the group consisting of: ATP9A, ATXN2, BAX, CUX2, IL1RL1, IL33, LBH, LOC441108, PTPN11, RAD50, RAD51L1, SH2B3, SLC22A4, SNX6, TBC1D8, TNKS2, TNXB, BRAP, ACAD10, ALDH2, MAPKAPK5, and ERP29, wherein different alleles of the at least one polymorphic marker of the at least one gene are associated with different susceptibilities to eosinophilia in humans, and determining a susceptibility to eosinophilia from the sequence data.

In a specific aspect of the invention, the method comprises obtaining sequence data about a human individual identifying at least one allele of at least one polymorphic marker of at least one gene selected from a sub-group of the above group of genes consisting of: LBH, TBC1D8, IL1RL1, WDR36, RAD50, TNXB, IL33, WDFY4, SH2B3, ATXN2, PTPN11, RAD51L1, SNX26, and ATP9A. In another specific aspect, the gene is selected from a group consisting of: IL1RL1, WDR36, TNXB, IL33, SH2B3, and ATXN2. In yet another specific aspect of the invention, the gene is selected from the group consisting of: IL1RL1, WDR36, TNXB, IL33, and SH2B3. The gene is IL1RL1 and/or SH2B3 in another aspect of the invention.

In one embodiment of the invention, the polymorphic marker of the at least one gene is one of rs11679137, rs4851400, rs2165427, rs1420101, rs2416257, rs11950562, rs272893, rs1050152, rs2188962, rs2244012, rs2897443, rs6871536, rs2269426, rs3939286, rs2663041, rs12411706, rs1265566, rs3184504, rs653178, rs11066320, rs7150454, rs927220, rs231228, rs1805419, rs1467412, and rs2426358, all of which are associated with and/or are physically located within one of the aforementioned genes.

Conditions Causative of, or Associated with or Correlative with Eosinophilia

In one aspect of the methods of determining a susceptibility to eosinophilia, the at least one allele further associates with a susceptibility to a condition which causes, correlates with, or associates with eosinophilia. In a specific embodiment of the invention, the at least one allele further associates with an increased susceptibility to a condition which causes, or is partially caused by, eosinophilia. The condition can be any condition, syndrome, or disease of which eosinophilia is a symptom. The condition can be, for example, eczema, leukemia, an autoimmune disease, an inflammatory disease, asthma, allergic rhinitis (hay fever), allergic rhinoconjuctivitis, atopic dermatitis, eosinophil esophagitis, eosinophilic fasciitis, a lung disease, vasculitis (e.g., Churg-Strauss syndrome), a tumor (e.g., a lymphoma), liver cirrhosis, an antibody deficiency, a myocardial infarction, rare skin diseases (e.g., dermatitis herptiformis, bullous pemphigoid), a parasitic infection (e.g., caused by helminths, e.g., *nematodes, schistosomes* and *plasmodium* species), or fungal infection such as *Pneumocystis carinii* pneumonia (Pcp). The condition can be a side effect of certain drugs. The side effect can be a side effect of an amphetamine, tranquilizer, bulk-type laxative containing psyllium, or an antibiotic. The drug can be an immunosuppressive drug, e.g., tacrolimus.

The autoimmune disease can be any disease in which the body produces an immune (i.e., immune system) response to some constituent of its own tissue. In other words the immune system loses its ability to recognize some tissue or system within the body as "self and targets and attacks it as if it were foreign, or loss of regulatory function of the immune system leads to its attack of the body's own constituents. Autoimmune diseases can be classified into those in which predominantly one organ is affected (e.g., hemolytic anemia and anti-immune thyroiditis), and those in which the autoimmune disease process is diffused through many tissues (e.g., systemic lupus erythematosus). For example, multiple sclerosis is thought to be caused by T cells attacking the sheaths that surround the nerve fibers of the brain and spinal cord. This results in loss of coordination, weakness, and blurred vision. Autoimmune diseases are known in the art and include, for instance, Hashimoto's thyroiditis, Grave's disease, lupus, multiple sclerosis, rheumatic arthritis, hemolytic anemia, anti-immune thyroiditis, systemic lupus erythematosus, celiac disease, Crohn's disease, colitis, diabetes, scleroderma, psoriasis, and the like.

The tumor can be a benign tumor, including, but not limited to any of a neoplasm, a hmartoma, a lipoma, a chondroma, a polyp, a cyst, fibroid, teratoma, or an adenoma. The tumor alternatively can be a malignant tumor, such as a malignant tumor of a cancer selected from: acute lymphocytic cancer, acute myeloid leukemia, alveolar rhabdomyosarcoma, bone cancer, brain cancer, breast cancer, cancer of the anus, anal canal, or anorectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia, chronic myeloid cancer, colon cancer, esophageal cancer, cervical cancer, gastrointestinal carcinoid tumor, Hodgkin lymphoma, hypopharynx cancer, kidney cancer, larynx cancer, liver cancer, lung cancer, malignant mesothelioma, melanoma, multiple myeloma, nasopharynx cancer, non-Hodgkin lymphoma, ovarian cancer, pancreatic cancer, peritoneum, omentum, and mesentery cancer, pharynx cancer, prostate cancer, rectal cancer, renal cancer (e.g., renal cell carcinoma (RCC)), small intestine cancer, soft tissue cancer, stomach cancer, testicular cancer, thyroid cancer, ureter cancer, and urinary bladder cancer.

An inflammatory disease can be any disease in which inflammation contributes to the pathogenesis, progress or symptoms of the disease. Inflammatory diseases include e.g. allergic diseases, asthma, arthritic diseases (e.g. rheumatoid arthritis, shoulder tendinitis or bursitis, Gouty arthritis, polymyalgia rheumatica and osteoarthritis), atherosclerosis, chronic obstructive lung disease, chronic inflammation, chronic prostatitis, fibromyalgia, glomerulonephritis, hypersensitivities, inflammatory bowel diseases, inflammatory myopahthies, myocardial infarction, obstructive sleep apnea, pelvic inflammatory disease, transplant rejection, vasculitis, and many of the autoimmune diseases.

In a specific aspect of the invention, wherein the allele further associates with an increased susceptibility to a condition which causes eosinophilia, the condition is asthma. In a more specific aspect, the condition is atopic asthma and the at least one allele is the A allele of rs1420101, the A allele of rs3939286, the G allele of rs2416257, and/or the T allele of rs9494145. In an alternative aspect, the condition is non-atopic asthma and the at least one allele is the A allele of rs1420101.

In a specific aspect of the invention, wherein the allele further associates with an increased susceptibility to a condition which causes eosinophilia, the condition is myocardial infarction. In an aspect of this embodiment, the at least one allele is the T allele of rs3184504 and/or the G allele of rs653178.

Methods of Determining a Susceptibility to Asthma

In view of the foregoing, the invention provides a method of determining a susceptibility to asthma in a human individual. The method comprises obtaining data about a human individual identifying at least one allele of at least one polymorphic marker of at least one gene selected from the group consisting of: IL1RL1, IL33, and WDR36, or identifying at least one allele of at least one polymorphic marker selected from the group consisting of: rs1420101, rs3939286, rs2416257, and rs9494145, and markers in linkage disequilibrium therewith, wherein different alleles of the at least one polymorphic marker are associated with different susceptibilities to asthma in humans, and determining a susceptibility to asthma from the sequence data.

In a specific aspect of the invention, the asthma is atopic asthma and the polymorphic marker is one of rs1420101, rs3939286, rs2416257, and rs9494145, and markers in linkage disequilibrium therewith. In a more specific aspect, the allele of the polymorphic marker is one of the A allele of rs1420101, the A allele of rs3939286, the G allele of rs2416257, and the T allele of rs9494145.

In another specific aspect of the invention, the asthma is non-atopic asthma and the polymorphic marker is rs1420101, and markers in linkage disequilibrium therewith. In a more specific aspect of the invention, the allele of the polymorphic marker is the A allele of rs1420101.

Methods of Determining a Susceptibility to Myocardial Infarction

The invention furthermore provides a method of determining a susceptibility to myocardial infarction in a human individual. The method comprises obtaining sequence data about a human individual identifying at least one allele of at least one polymorphic marker of at least one gene selected from the group consisting of: SH2B3 and ATXN2, or identifying at least one allele of at least one polymorphic marker selected from the group consisting of: rs3184504 and rs653178, and markers in linkage disequilibrium therewith, wherein different alleles of the at least one polymorphic marker is associated with different susceptibilities to myocardial infarction in humans, and determining a susceptibility to myocardial infarction from the sequence data. In a specific embodiment, markers in linkage disequilibrium are selected from the group consisting of rs2106409, rs4766521, rs3919447, rs4766522, rs2106407, rs2106406, rs12425190, rs2339706, rs4509829, rs11838131, rs12818548, rs4766523, rs4766524, rs7961663, rs7961935, rs7978821, rs4766526, rs4766442, rs4766443, rs12815195, rs4766527, rs12814105, rs991817, rs11065784, rs7968960, rs4378452, rs10774613, rs1265566, rs7970490, rs3847953, rs6490055, rs11065884, rs10849944, rs7302763, rs10849946, rs4766573, rs10774623, rs12580300, rs11065898, rs10849947, rs2283358, rs7296313, rs2239195, rs2238154, rs3184504, rs739496, rs10849949, rs2073950, rs2301622, rs2301621, rs4766578, rs10774625, rs2339816, rs1029388, rs6490162, rs628825, rs630512, rs688812, rs657197, rs607316, rs616668, rs648997, rs625093, rs638791, rs593226, rs616559, rs616513, rs653178, rs12369009, rs695871, rs11065987, rs601663, rs2238151, rs10744777.

In a specific aspect of the invention, when the polymorphic marker is rs3184504 or rs653178, the allele of the polymorphic marker is one of the T allele of rs3184504 and the G allele of rs653178.

Methods of Determining a Susceptibility to Hypertension

The invention moreover provides a method of determining a susceptibility to hypertension in a human individual. The method comprises obtaining sequence data about a human individual identifying at least one allele of at least one polymorphic marker of at least one gene selected from the group consisting of: SH2B3, or identifying at least one allele of at least one polymorphic marker selected from the group consisting of: rs3184504, and markers in linkage disequilibrium therewith, wherein different alleles of the at least one polymorphic marker are associated with different susceptibilities to hypertension in humans, and determining a susceptibility to hypertension from the sequence data.

In a specific aspect of the invention, when the polymorphic marker is rs3184504, the allele of the polymorphic marker is the T allele of rs3184504.

Number of Polymorphic Markers/Genes Analyzed

With regard to the methods of determining a susceptibility described herein, the methods can comprise obtaining sequence data about any number of polymorphic markers and/or about any number of genes. For example, the method can comprise obtaining sequence data for about at least 1, 2, 3, 4, 5, 6, 7, 8, 9, 10, 15, 20, 25, 30, 40, 50, 100, 500, 1000, 10,000 or more polymorphic markers or genes. The markers can be independent and/or some of the markers can be part of a haplotype. The polymorphic markers or genes can be the ones of the group specified herein or can be a different polymorphic marker or gene that is not listed in the group, including, for example, a different polymorphic marker or gene that has been previously identified as associating with eosinophilia, asthma, myocardial infarction, and/or hypertension. In a specific embodiment, the method comprises obtaining sequence data about at least two polymorphic markers from at least two different genes. For example, in some instances, if the method comprises obtaining nucleic acid data about a human individual identifying at least one allele of the polymorphic marker rs1420101, then the method comprises identifying at least one allele of at least one other polymorphic marker, e.g., a polymorphic marker which is not related to rs1420101 (e.g., a marker which is not in linkage disequilibrium with rs1420101). Also, for example, the method can comprise obtaining sequence data about a human individual identifying alleles of multiple, independent haplotypes, which are not in linkage disequilibrium. In another specific embodiment of the invention, the method comprises obtaining nucleic acid sequence data about at least one polymorphic marker from each gene or polymorphic marker of the specified group.

Obtaining Nucleic Acid Sequence Data

With regard to the methods of determining a susceptibility to eosinophilia, asthma, myocardial infarction, or hypertension, the sequence data can be nucleic acid sequence data, which may be obtained by means known in the art. For example, the nucleic acid sequence data may be obtained through direct analysis of the sequence of the allele of the polymorphic marker. Suitable methods, some of which are described herein, include, for instance, whole genome analysis using a whole genome SNP chip (e.g., Infinium HD Bead-Chip), cloning for polymorphisms, non-radioactive PCR-single strand conformation polymorphism analysis, denaturing high pressure liquid chromatography (DHPLC), DNA hybridization, computational analysis, single-stranded conformational polymorphism (SSCP), restriction fragment length polymorphism (RFLP), automated fluorescent sequencing; clamped denaturing gel electrophoresis (CDGE); denaturing gradient gel electrophoresis (DGGE), mobility shift analysis, restriction enzyme analysis; heteroduplex analysis, chemical mismatch cleavage (CMC), RNase protection assays, use of polypeptides that recognize nucleotide mismatches, such as *E. coli* mutS protein, allele-specific PCR, and direct manual sequencing. These and other methods are described in the art (see, for instance, Li et al., *Nucleic Acids Research*, 28(2): e1 (i-v) (2000); Liu et al., *Biochem Cell Bio* 80:17-22 (2000); and Burczak et al., *Polymorphism Detection and Analysis*, Eaton Publishing, 2000; Sheffield et al., *Proc. Natl. Acad. Sci. USA*, 86:232-236 (1989); Orita et al., *Proc. Natl. Acad. Sci. USA*, 86:2766-2770 (1989); Flavell et al., *Cell*, 15:25-41 (1978); Geever et al., *Proc. Natl. Acad. Sci. USA*, 78:5081-5085 (1981); Cotton et al., *Proc. Natl. Acad. Sci. USA*, 85:4397-4401 (1985); Myers et al., *Science* 230:1242-1246 (1985); Church and Gilbert, *Proc. Natl. Acad. Sci. USA*, 81:1991-1995 (1988); Sanger et al., *Proc. Natl. Acad. Sci. USA*, 74:5463-5467 (1977); and Beavis et al., U.S. Pat. No. 5,288,644).

In one embodiment, diagnosis of a susceptibility to eosinophilia, asthma, myocardial infarction, and/or hypertension can be accomplished using a hybridization method (see *Current Protocols in Molecular Biology*, Ausubel et al., eds., John Wiley & Sons, including all supplements). A biological sample of genomic DNA, RNA, or cDNA (a "test sample") is obtained from a test subject or individual suspected of having, being susceptible to, experiencing symptoms associated with, or predisposed for eosinophilia, asthma, and/or myocardial infarction (the "test subject"). The subject can be an adult, child, or fetus. A test sample of DNA from fetal cells or tissue can be obtained by appropriate methods, such as by amniocentesis or chorionic villus sampling. The DNA, RNA, or cDNA sample is then examined. The presence of a specific marker allele can be indicated by sequence-specific hybridization of a nucleic acid probe specific for the particular allele. The presence of more than one specific marker allele or a specific haplotype can be indicated by using several sequence-specific nucleic acid probes, each being specific for a particular allele. In one embodiment, a haplotype can be indicated by a single nucleic acid probe that is specific for the specific haplotype (i.e., hybridizes specifically to a DNA strand comprising the specific marker alleles characteristic of the haplotype). A sequence-specific probe can be directed to hybridize to genomic DNA, RNA, or cDNA. A "nucleic acid probe", as used herein, can be a DNA probe or an RNA probe that hybridizes to a complementary sequence. One of skill in the art would know how to design such a probe so that sequence specific hybridization will occur only if a particular allele is present in a genomic sequence from a test sample.

To diagnose a susceptibility to eosinophilia, asthma, myocardial infarction, and/or hypertension, or symptoms associated with eosinophilia, asthma, myocardial infarction, and/or hypertension, a hybridization sample can be formed by contacting the test sample containing an eosinophilia-, asthma-, myocardial infarction-, and/or hypertension-associated nucleic acid, such as a genomic DNA sample, with at least one nucleic acid probe. A non-limiting example of a probe for detecting mRNA or genomic DNA is a labeled nucleic acid probe that is capable of hybridizing to mRNA or genomic DNA sequences described herein. The nucleic acid probe can be, for example, a full-length nucleic acid molecule, or a portion thereof, such as an oligonucleotide of at least 10, 15, 30, 50, 100, 250 or 500 nucleotides in length that is sufficient to specifically hybridize under stringent conditions to appropriate mRNA or genomic DNA. For example, the nucleic acid probe can comprise all or a portion of the nucleotide sequence of a gene selected from the group consisting of ATP9A, ATXN2, BAX, CUX2, IL1RL1, IL33, LBH, LOC441108, PTPN11, RAD50, RAD51L1, SH2B3, SLC22A4, SNX6, TBC1D8, TNKS2, TNXB, BRAP, ACAD10, ALDH2, MAPKAPK5, and ERP29, and/or a LD block of any one of these genes, as described herein, optionally comprising at least one allele of a marker described herein, or at least one haplotype described herein, or the probe can be the complementary sequence of such a sequence. In a particular embodiment, the nucleic acid probe is a portion of the nucleotide sequence of a gene selected from the above group and/or the LD block of the gene, as described herein, optionally comprising at least one allele of a marker described herein, or at least one allele of a polymorphic marker of a haplotype comprising at least one polymorphic marker described herein, or the probe can be the complementary sequence of such a sequence. Other suitable probes for use in the diagnostic assays of the invention are described herein. Hybridization can be performed by methods well known to the person skilled in the art (see, e.g., *Current Protocols in Molecular Biology*, Ausubel et al., eds., John Wiley & Sons, including all supplements). In one embodiment, hybridization refers to specific hybridization, i.e., hybridization with no mismatches (exact hybridization). In one embodiment, the hybridization conditions for specific hybridization are high stringency.

Specific hybridization, if present, is detected using standard methods. If specific hybridization occurs between the nucleic acid probe and the nucleic acid in the test sample, then the sample contains the allele that is complementary to the nucleotide that is present in the nucleic acid probe. The process can be repeated for any markers of the invention, or markers that make up a haplotype of the invention, or multiple probes can be used concurrently to detect more than one marker alleles at a time. It is also possible to design a single probe containing more than one marker alleles of a particular haplotype (e.g., a probe containing alleles complementary to 2, 3, 4, 5 or all of the markers that make up a particular haplotype). Detection of the particular markers of the haplotype in the sample is indicative of the source of the sample having the particular haplotype (e.g., a haplotype) and therefore is susceptible to eosinophilia, asthma, myocardial infarction, and/or hypertension.

In one embodiment, a method utilizing a detection oligonucleotide probe comprising a fluorescent moiety or group at its 3' terminus and a quencher at its 5' terminus, and an enhancer oligonucleotide, is employed, as described by Kutyavin et al. (*Nucleic Acid Res.* 34:e128 (2006)). The fluorescent moiety can be Gig Harbor Green or Yakima Yellow, or other suitable fluorescent moieties. The detection probe is designed to hybridize to a short nucleotide sequence that includes the SNP polymorphism to be detected. Preferably, the SNP is anywhere from the terminal residue to −6 residues from the 3' end of the detection probe. The enhancer is a short oligonucleotide probe which hybridizes to the DNA template 3' relative to the detection probe. The probes are designed such that a single nucleotide gap exists between the detection probe and the enhancer nucleotide probe when both are bound to the template. The gap creates a synthetic abasic site that is recognized by an endonuclease, such as Endonuclease IV. The enzyme cleaves the dye off the fully complementary detection probe, but cannot cleave a detection probe containing a mismatch. Thus, by measuring the fluorescence of the released fluorescent moiety, assessment of the presence of a particular allele defined by nucleotide sequence of the detection probe can be performed.

The detection probe can be of any suitable size, although preferably the probe is relatively short. In one embodiment, the probe is from 5-100 nucleotides in length. In another embodiment, the probe is from 10-50 nucleotides in length, and in another embodiment, the probe is from 12-30 nucleotides in length. Other lengths of the probe are possible and within scope of the skill of the average person skilled in the art.

In a preferred embodiment, the DNA template containing the SNP polymorphism is amplified by Polymerase Chain Reaction (PCR) prior to detection. In such an embodiment, the amplified DNA serves as the template for the detection probe and the enhancer probe.

Certain embodiments of the detection probe, the enhancer probe, and/or the primers used for amplification of the template by PCR include the use of modified bases, including modified A and modified G. The use of modified bases can be useful for adjusting the melting temperature of the nucleotide molecule (probe and/or primer) to the template DNA, for example for increasing the melting temperature in regions containing a low percentage of G or C bases, in which modified A with the capability of forming three hydrogen bonds to its complementary T can be used, or for decreasing the melting temperature in regions containing a high percentage of G or C bases, for example by using modified G bases that form only two hydrogen bonds to their complementary C base in a double stranded DNA molecule. In a preferred embodiment, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In another hybridization method, Northern analysis (see *Current Protocols in Molecular Biology*, Ausubel et al., eds., John Wiley & Sons, supra) is used to identify the presence of a polymorphism associated with eosinophilia, asthma, myocardial infarction, and/or hypertension. For Northern analysis, a test sample of RNA is obtained from the subject by appropriate means. As described herein, specific hybridization of a nucleic acid probe to RNA from the subject is indicative of a particular allele complementary to the probe. For representative examples of use of nucleic acid probes, see, for example, U.S. Pat. Nos. 5,288,611 and 4,851,330.

Additionally, or alternatively, a peptide nucleic acid (PNA) probe can be used in addition to, or instead of, a nucleic acid probe in the hybridization methods described herein. A PNA is a DNA mimic having a peptide-like, inorganic backbone, such as N-(2-aminoethyl)glycine units, with an organic base (A, G, C, T or U) attached to the glycine nitrogen via a methylene carbonyl linker (see, for example, Nielsen et al., *Bioconjug. Chem.* 5:3-7 (1994)). The PNA probe can be designed to specifically hybridize to a molecule in a sample suspected of containing one or more of the marker alleles or haplotypes that are associated with eosinophilia, asthma, myocardial infarction, and/or hypertension. Hybridization of the PNA probe is thus diagnostic for eosinophilia, asthma, myocardial infarction, and/or hypertension.

In one embodiment of the invention, a test sample containing genomic DNA obtained from the subject is collected and the polymerase chain reaction (PCR) is used to amplify a fragment comprising one or more markers or haplotypes of the invention. As described herein, identification of a particular marker allele or haplotype associated with eosinophilia, asthma, myocardial infarction, and/or hypertension can be accomplished using a variety of methods (e.g., sequence analysis, analysis by restriction digestion, specific hybridization, single stranded conformation polymorphism assays (SSCP), electrophoretic analysis, etc.). In another embodiment, diagnosis is accomplished by expression analysis, for example using quantitative PCR (kinetic thermal cycling). This technique can, for example, utilize commercially available technologies, such as TaqMan® (Applied Biosystems, Foster City, Calif.). The technique can assess the presence of an alteration in the expression or composition of a polypeptide or splicing variant(s) that is encoded by a nucleic acid associated with eosinophilia, asthma, myocardial infarction, and/or hypertension. Further, the expression of the variant(s) can be quantified as physically or functionally different.

In another method of the invention, analysis by restriction digestion can be used to detect a particular allele if the allele results in the creation or elimination of a restriction site relative to a reference sequence. Restriction fragment length polymorphism (RFLP) analysis can be conducted, e.g., as described in *Current Protocols in Molecular Biology*, supra. The digestion pattern of the relevant DNA fragment indicates the presence or absence of the particular allele in the sample.

Sequence analysis can also be used to detect specific alleles or haplotypes associated with eosinophilia, asthma, myocardial infarction, and/or hypertension (e.g. the polymorphic markers of Table 3, and markers in linkage disequilibrium therewith). Therefore, in one embodiment, determination of the presence or absence of a particular marker allele or haplotype comprises sequence analysis of a test sample of DNA or RNA obtained from a subject or individual. PCR or other appropriate methods can be used to amplify a portion of a nucleic acid associated with eosinophilia, asthma, myocardial infarction, and/or hypertension and the presence of a specific allele can then be detected directly by sequencing the polymorphic site (or multiple polymorphic sites in a haplotype) of the genomic DNA in the sample.

Allele-specific oligonucleotides can also be used to detect the presence of a particular allele in a nucleic acid associated with eosinophilia, asthma, myocardial infarction, and/or hypertension (e.g. the polymorphic markers of Table 3, and markers in linkage disequilibrium therewith), through the use of dot-blot hybridization of amplified oligonucleotides with allele-specific oligonucleotide (ASO) probes (see, for example, Saiki et al., *Nature* 324:163-166 (1986)). An "allele-specific oligonucleotide" (also referred to herein as an "allele-specific oligonucleotide probe") is an oligonucleotide of approximately 10-50 base pairs or approximately 15-30 base pairs, that specifically hybridizes to a nucleic acid associated with eosinophilia, asthma, myocardial infarction, and/or hypertension and which contains a specific allele at a polymorphic site (e.g., a marker or haplotype as described herein). An allele-specific oligonucleotide probe that is specific for one or more particular a nucleic acid associated with eosinophilia, asthma, myocardial infarction, and/or hypertension can be prepared using standard methods (see, e.g., *Current Protocols in Molecular Biology*, supra). PCR can be used to amplify the desired region. The DNA containing the amplified region can be dot-blotted using standard methods (see, e.g., *Current Protocols in Molecular Biology*, supra), and the blot can be contacted with the oligonucleotide probe. The presence of specific hybridization of the probe to the amplified region can then be detected. Specific hybridization of an allele-specific oligonucleotide probe to DNA from the subject is indicative of a specific allele at a polymorphic site associated with a disease (see, e.g., Gibbs et al., *Nucleic Acids Res.* 17:2437-2448 (1989) and WO 93/22456).

With the addition of analogs such as locked nucleic acids (LNAs), the size of primers and probes can be reduced to as few as 8 bases. LNAs are a novel class of bicyclic DNA analogs in which the 2' and 4' positions in the furanose ring are joined via an O-methylene (oxy-LNA), S-methylene (thio-LNA), or amino methylene (amino-LNA) moiety. Common to all of these LNA variants is an affinity toward complementary nucleic acids, which is by far the highest reported for a DNA analog. For example, particular all oxy-LNA nonamers have been shown to have melting temperatures (Tm) of 64° C. and 74° C. when in complex with complementary DNA or RNA, respectively, as opposed to 28° C. for both DNA and RNA for the corresponding DNA nonamer. Substantial increases in Tm are also obtained when LNA monomers are used in combination with standard DNA or RNA monomers. For primers and probes, depending on where the LNA monomers are included (e.g., the 3' end, the 5' end, or in the middle), the Tm could be increased considerably.

In another embodiment, arrays of oligonucleotide probes that are complementary to target nucleic acid sequence segments from a subject, can be used to identify polymorphisms in a nucleic acid associated with eosinophilia, asthma, myocardial infarction, and/or hypertension (e.g. the polymorphic markers of Table 3 and markers in linkage disequilibrium therewith). For example, an oligonucleotide array can be used. Oligonucleotide arrays typically comprise a plurality of different oligonucleotide probes that are coupled to a surface of a substrate in different known locations. These arrays can generally be produced using mechanical synthesis methods or light directed synthesis methods that incorporate a combination of photolithographic methods and solid phase oligonucleotide synthesis methods, or by other methods known to the person skilled in the art (see, e.g., Bier et al., *Adv Biochem Eng Biotechnol* 109:433-53 (2008); Hoheisel, *Nat Rev Genet.* 7:200-10 (2006); Fan et al., *Methods Enzymol* 410:57-73 (2006); Raqoussis & Elvidge, *Expert Rev Mol Diagn* 6:145-52 (2006); Mockler et al., *Genomics* 85:1-15 (2005), and references cited therein, the entire teachings of each of which are incorporated by reference herein). Many additional descriptions of the preparation and use of oligonucleotide arrays for detection of polymorphisms can be found, for example, in U.S. Pat. No. 6,858,394, U.S. Pat. No. 6,429,027, U.S. Pat. No. 5,445,934, U.S. Pat. No. 5,700,637, U.S. Pat. No. 5,744,305, U.S. Pat. No. 5,945,334, U.S. Pat. No. 6,054,270, U.S. Pat. No. 6,300,063, U.S. Pat. No. 6,733,977, U.S. Pat. No. 7,364,858, EP 619 321, and EP 373 203, the entire teachings of which are incorporated by reference herein.

Also, standard techniques for genotyping can be used, such as fluorescence-based techniques (e.g., Chen et al., *Genome Res.* 9(5): 492-98 (1999); Kutyavin et al., *Nucleic Acid Res.* 34:e128 (2006)), utilizing PCR, LCR, Nested PCR and other techniques for nucleic acid amplification. Specific commercial methodologies available for SNP genotyping include, but are not limited to, TaqMan genotyping assays and SNPlex platforms (Applied Biosystems), gel electrophoresis (Applied Biosystems), mass spectrometry (e.g., MassARRAY system from Sequenom), minisequencing methods, real-time PCR, Bio-Plex system (BioRad), CEQ and SNPstream systems (Beckman), array hybridization technology (e.g., Affymetrix GeneChip; Perlegen), BeadArray Technologies (e.g., Illumina GoldenGate and Infinium assays), array tag technology (e.g., Parallele), and endonuclease-based fluorescence hybridization technology (Invader; Third Wave). Some of the available array platforms, including Affymetrix SNP Array 6.0 and Illumina CNV370-Duo and 1M BeadChips, include SNPs that tag certain copy number variations (CNVs). This allows detection of CNVs via surrogate SNPs included in these platforms. Thus, by use of these or other methods available to the person skilled in the art, one or more alleles at polymorphic markers, including microsatellites, SNPs or other types of polymorphic markers, can be identified.

The direct sequence analysis can be of the nucleic acid of a biological sample obtained from the human individual for which a susceptibility is being determined. The biological sample can be any sample containing nucleic acid (e.g., genomic DNA) obtained from the human individual. For example, the biological sample can be a blood sample, a serum sample, a leukopheresis sample, an amniotic fluid sample, a cerebrospinal fluid sample, a hair sample, a tissue sample from skin, muscle, buccal, or conjunctival mucosa, placenta, gastrointestinal tract, or other organs, a semen sample, a urine sample, a saliva sample, a nail sample, a tooth sample, and the like.

In a specific aspect of the invention, obtaining nucleic acid sequence data comprises obtaining nucleic acid sequence information from a preexisting record, e.g., a preexisting medical record comprising genotype information of the human individual. For example, direct sequence analysis of the allele of the polymorphic marker can be accomplished by mining a pre-existing genotype dataset for the sequence of the allele of the polymorphic marker.

Indirect Analysis

Alternatively, the nucleic acid sequence data may be obtained through indirect analysis of the nucleic acid sequence of the allele of the polymorphic marker. For example, the allele could be one which leads to the expression of a variant protein comprising an altered amino acid sequence, as compared to the non-variant (e.g., wild-type) protein, due to one or more amino acid substitutions, deletions, or insertions, or truncation (due to, e.g., splice variation). For example, the allele could be one of the A allele of rs272893, which leads to a substitution of Ile at position 306 of GenBank Accession No. NP_003050 with Thr, the C allele of rs1050152, which leads to a substitution of Leu at position 503 of the amino acid sequence of GenBank Accession No. NP_003050 with Phe, or the T allele of rs3184504, which leads to a substitution of Trp at position 262 of GenBank Accession No. NP 005466 with Arg. In this instance, nucleic acid sequence data about the allele of the polymorphic marker can be obtained through detection of the amino acid substitution of the variant protein. Methods of detecting variant proteins are known in the art. For example, direct amino acid sequencing of the variant protein followed by comparison to a reference amino acid sequence can be used. Alternatively, SDS-PAGE followed by gel staining can be used to detect variant proteins of different molecular weights. Also, Immunoassays, e.g., immunofluorescent immunoassays, immunoprecipitations, radioimmunoassays, ELISA, and Western blotting, in which an antibody specific for an epitope comprising the variant sequence among the variant protein and non-variant or wild-type protein can be used.

It is also possible, for example, for the variant protein to demonstrate altered (e.g., upregulated or downregulated) biological activity, in comparison to the non-variant or wild-type protein. The biological activity can be, for example, a binding activity or enzymatic activity. In this instance, nucleic acid sequence data about the allele of the polymorphic marker can be obtained through detection of the altered biological activity. Methods of detecting binding activity and enzymatic activity are known in the art and include, for instance, ELISA, competitive binding assays, quantitative binding assays using instruments such as, for example, a Biacore® 3000 instrument, chromatographic assays, e.g., HPLC and TLC.

Alternatively or additionally, the polymorphic variant (the allele of the polymorphic marker) could lead to an altered expression level, e.g., an increased expression level of an mRNA or protein, a decreased expression level of an mRNA or protein. Nucleic acid sequence data about the allele of the polymorphic marker can, in these instances, be obtained through detection of the altered expression level. Methods of detecting expression levels are known in the art. For example, ELISA, radioimmunoassays, immunofluorescence, and Western blotting can be used to compare the expression of protein levels. Alternatively, Northern blotting can be used to compare the levels of mRNA. These processes are described in Sambrook et al., *Molecular Cloning: A Laboratory Manual*, 3$^{rd}$ ed. Cold Spring Harbor Laboratory Press, Cold Spring Harbor, N.Y. (2001).

The indirect sequence analysis can be of the nucleic acid (e.g., DNA, mRNA) or protein of a biological sample obtained from the human individual for which a susceptibility is being determined. The biological sample can be any nucleic acid or protein containing sample obtained from the human individual. For example, the biological sample can be any of the biological samples described herein.

In view of the foregoing, analyzing the sequence of the at least one polymorphic marker can comprise determining the presence or absence of at least one allele of the at least one polymorphic marker, or it can comprise analyzing the sequence of the polymorphic marker of a particular sample. Further, analyzing the sequence of the at least one polymorphic marker can comprise determining the presence or absence of an amino acid substitution in the amino acid sequence encoded by the polymorphic marker of at least one gene of the group, or it can comprise obtaining a biological sample from the human individual and analyzing the amino acid sequence encoded by at least one gene of the group.

Linkage Disequilibrium

The nucleic acid sequence data may be obtained through other means of indirect analysis of the nucleic acid sequence of the allele of the polymorphic marker. For example, obtaining the nucleic acid data can comprise identifying at least one allele of a marker in linkage disequilibrium with at least one polymorphic marker associated with eosinophilia, asthma, myocardial infarction, and/or hypertension, as described herein.

Linkage Disequilibrium (LD) refers to a non-random assortment of two genetic elements. For example, if a particular genetic element (e.g., an allele of a polymorphic marker, or a haplotype) occurs in a population at a frequency of 0.50 (50%) and another element occurs at a frequency of 0.50 (50%), then the predicted occurrence of a person's having both elements is 0.25 (25%), assuming a random distribution of the elements. However, if it is discovered that the two elements occur together at a frequency higher than 0.25, then the elements are said to be in linkage disequilibrium, since they tend to be inherited together at a higher rate than what their independent frequencies of occurrence (e.g., allele or haplotype frequencies) would predict. Roughly speaking, LD is generally correlated with the frequency of recombination events between the two elements. Allele or haplotype frequencies can be determined in a population by genotyping individuals in a population and determining the frequency of the occurrence of each allele or haplotype in the population. For populations of diploids, e.g., human populations, individuals will typically have two alleles for each genetic element (e.g., a marker, haplotype or gene).

Many different measures have been proposed for assessing the strength of linkage disequilibrium (LD; reviewed in Devlin, B. & Risch, N., *Genomics* 29:311-22 (1995)). Most capture the strength of association between pairs of biallelic sites. Two important pairwise measures of LD are $r^2$ (sometimes denoted $\Delta^2$) and |D'| (Lewontin, R., *Genetics* 49:49-67 (1964); Hill, W. G. & Robertson, A. *Theor. Appl. Genet.* 22:226-231 (1968)). Both measures range from 0 (no disequilibrium) to 1 ('complete' disequilibrium), but their interpretation is slightly different. |D'| is defined in such a way that it is equal to 1 if just two or three of the possible haplotypes are present, and it is <1 if all four possible haplotypes are present. Therefore, a value of |D'| that is <1 indicates that historical recombination may have occurred between two sites (recurrent mutation can also cause |D'| to be <1, but for single nucleotide polymorphisms (SNPs) this is usually regarded as being less likely than recombination). The measure $r^2$ represents the statistical correlation between two sites, and takes the value of 1 if only two haplotypes are present.

The $r^2$ measure is arguably the most relevant measure for association mapping, because there is a simple inverse relationship between $r^2$ and the sample size required to detect association between susceptibility loci and SNPs. These measures are defined for pairs of sites, but for some applications a determination of how strong LD is across an entire region that contains many polymorphic sites might be desirable (e.g., testing whether the strength of LD differs significantly among loci or across populations, or whether there is more or less LD in a region than predicted under a particular model). Measuring LD across a region is not straightforward, but one approach is to use the measure r, which was developed in population genetics. Roughly speaking, r measures how much recombination would be required under a particular population model to generate the LD that is seen in the data. This type of method can potentially also provide a statistically rigorous approach to the problem of determining whether LD data provide evidence for the presence of recombination hotspots.

For the methods described herein, a significant $r^2$ value can be at least 0.1 such as at least 0.1, 0.15, 0.2, 0.25, 0.3, 0.35, 0.4, 0.45, 0.5, 0.55, 0.6, 0.65, 0.7, 0.75, 0.8, 0.85, 0.9, 0.91, 0.92, 0.93, 0.94, 0.95, 0.96, 0.97, 0.98, 0.99 or 1.0. In one specific embodiment of invention, the significant $r^2$ value can be at least 0.2. Alternatively, linkage disequilibrium as described herein, refers to linkage disequilibrium characterized by values of |D'| of at least 0.2, such as 0.3, 0.4, 0.5, 0.6, 0.7, 0.8, 0.85, 0.9, 0.95, 0.96, 0.97, 0.98, 0.99. Thus, linkage disequilibrium represents a correlation between alleles of distinct markers. It is measured by correlation coefficient or |D'| ($r^2$ up to 1.0 and |D'| up to 1.0). Linkage disequilibrium can be determined in a single human population, as defined herein, or it can be determined in a collection of samples comprising individuals from more than one human population. In one embodiment of the invention, LD is determined in a sample from one or more of the HapMap populations. These include samples from the Yoruba people of Ibadan, Nigeria (YRI), samples from individuals from the Tokyo area in Japan (JPT), samples from individuals Beijing, China (CHB), and samples from U.S. residents with northern and western European ancestry (CEU), as described (The International HapMap Consortium, *Nature* 426:789-796 (2003)). In one such embodiment, LD is determined in the Caucasian CEU population of the HapMap samples. In another embodiment, LD is determined in the African YRI population. In yet another embodiment, LD is determined in samples from the Icelandic population.

If all polymorphisms in the genome were independent at the population level (i.e., no LD between polymorphisms), then every single one of them would need to be investigated in association studies, to assess all different polymorphic states. However, due to linkage disequilibrium between polymorphisms, tightly linked polymorphisms are strongly correlated, which reduces the number of polymorphisms that need to be investigated in an association study to observe a significant association. Another consequence of LD is that many polymorphisms may give an association signal due to the fact that these polymorphisms are strongly correlated.

Genomic LD maps have been generated across the genome, and such LD maps have been proposed to serve as framework for mapping disease-genes (Risch, N. & Merkiangas, K, *Science* 273:1516-1517 (1996); Maniatis, N., et al., *Proc Natl Acad Sci USA* 99:2228-2233 (2002); Reich, D E et al, *Nature* 411:199-204 (2001)).

It is now established that many portions of the human genome can be broken into series of discrete haplotype blocks containing a few common haplotypes; for these blocks, linkage disequilibrium data provides little evidence indicating recombination (see, e.g., Wall., J. D. and Pritchard, J. K., *Nature Reviews Genetics* 4:587-597 (2003); Daly, M. et al., *Nature Genet.* 29:229-232 (2001); Gabriel, S. B. et al., *Science* 296:2225-2229 (2002); Patil, N. et al., *Science* 294:1719-1723 (2001); Dawson, E. et al., *Nature* 418:544-548 (2002); Phillips, M. S. et al., *Nature Genet.* 33:382-387 (2003)).

There are two main methods for defining these haplotype blocks: blocks can be defined as regions of DNA that have limited haplotype diversity (see, e.g., Daly, M. et al., *Nature Genet.* 29:229-232 (2001); Patil, N. et al., *Science* 294:1719-1723 (2001); Dawson, E. et al., *Nature* 418:544-548 (2002); Zhang, K. et al., *Proc. Natl. Acad. Sci. USA* 99:7335-7339 (2002)), or as regions between transition zones having extensive historical recombination, identified using linkage disequilibrium (see, e.g., Gabriel, S. B. et al., *Science* 296:2225-2229 (2002); Phillips, M. S. et al., *Nature Genet.* 33:382-387 (2003); Wang, N. et al., *Am. J. Hum. Genet.* 71:1227-1234 (2002); Stumpf, M. P., and Goldstein, D. B., *Curr. Biol.* 13:1-8 (2003)). More recently, a fine-scale map of recombination rates and corresponding hotspots across the human genome has been generated (Myers, S., et al., *Science* 310: 321-32324 (2005); Myers, S. et al., *Biochem Soc Trans* 34:526530 (2006)). The map reveals the enormous variation in recombination across the genome, with recombination rates as high as 10-60 cM/Mb in hotspots, while closer to 0 in intervening regions, which thus represent regions of limited haplotype diversity and high LD. The map can therefore be used to define haplotype blocks/LD blocks as regions flanked by recombination hotspots. As used herein, the terms "haplotype block" or "LD block" includes blocks defined by any of the above described characteristics, or other alternative methods used by the person skilled in the art to define such regions.

Haplotype blocks (LD blocks) can be used to map associations between phenotype and haplotype status, using single markers or haplotypes comprising a plurality of markers. The main haplotypes can be identified in each haplotype block, and then a set of "tagging" SNPs or markers (the smallest set of SNPs or markers needed to distinguish among the haplotypes) can then be identified. These tagging SNPs or markers can then be used in assessment of samples from groups of individuals, in order to identify association between phenotype and haplotype. If desired, neighboring haplotype blocks can be assessed concurrently, as there may also exist linkage disequilibrium among the haplotype blocks.

It has thus become apparent that for any given observed association to a polymorphic marker in the genome, it is likely that additional markers in the genome also show association. This is a natural consequence of the uneven distribution of LD across the genome, as observed by the large variation in recombination rates. The markers used to detect association thus in a sense represent "tags" for a genomic region (i.e., a haplotype block or LD block) that is associating with a given disease or trait, and as such are useful for use in the methods and kits of the invention. One or more causative (functional) variants or mutations may reside within the region found to be associating to the disease or trait. The functional variant may be another SNP, a tandem repeat polymorphism (such as a minisatellite or a microsatellite), a transposable element, or a copy number variation, such as an inversion, deletion or insertion. Such variants in LD with other variants used to detect an association to a disease or trait (e.g., the variants described herein to be associated with risk of eosinophilia, asthma, myocardial infarction, and/or hypertension) may confer a higher relative risk (RR) or odds ratio (OR) than observed for the tagging markers used to detect the association. The invention thus refers to the markers used for detecting association to the disease, as described herein, as well as markers in linkage disequilibrium with the markers. Thus, in certain embodiments of the invention, markers that are in LD with the markers and/or haplotypes of the invention, as described herein, may be used as surrogate markers. The surrogate markers have in one embodiment relative risk (RR) and/or odds ratio (OR) values smaller than for the markers or haplotypes initially found to be associating with the disease, as described herein. In other embodiments, the surrogate markers have RR or OR values greater than those initially determined for the markers initially found to be associating with the disease, as described herein. An example of such an embodiment would be a rare, or relatively rare (<10% allelic population frequency) variant in LD with a more common variant (>10% population frequency) initially found to be associating with the disease, such as the variants described herein. Identifying and using such markers for detecting the association discovered by the inventors as described herein can be performed by routine methods well known to the person skilled in the art, and are therefore within the scope of the invention.

In view of the foregoing, the marker in linkage disequilibrium with a polymorphic marker associated with eosinophilia, asthma, myocardial infarction, and/or hypertension may be one of the surrogate markers listed in Table 2. The markers were selected using data for the Caucasian CEU samples from the HapMap dataset (http://www.hapmap.org).

TABLE 2

| surrogate marker | anchor marker | D' | r² | chromosome | position |
|---|---|---|---|---|---|
| rs12617902 | rs12619285 | 1 | 0.239669 | C02 | 213497136 |
| rs4672665 | rs12619285 | 1 | 0.239669 | C02 | 213498708 |
| rs16849446 | rs12619285 | 1 | 0.244447 | C02 | 213500207 |
| rs975381 | rs12619285 | 1 | 0.252874 | C02 | 213524876 |
| rs2170572 | rs12619285 | 1 | 1 | C02 | 213525464 |
| rs7560454 | rs12619285 | 1 | 1 | C02 | 213526823 |
| rs12619285 | rs12619285 | 1 | 1 | C02 | 213532290 |
| rs10189498 | rs12619285 | 1 | 1 | C02 | 213534396 |
| rs6750754 | rs12619285 | 1 | 1 | C02 | 213538432 |
| rs6740906 | rs12619285 | 1 | 0.883833 | C02 | 213540967 |
| rs1482577 | rs12619285 | 1 | 0.885057 | C02 | 213543369 |
| rs13022407 | rs12619285 | 1 | 0.885057 | C02 | 213544451 |
| rs10199053 | rs12619285 | 1 | 0.204244 | C02 | 213545970 |
| rs17276404 | rs12619285 | 1 | 0.568966 | C02 | 213554080 |
| rs7588793 | rs12619285 | 1 | 0.249753 | C02 | 213558644 |
| rs12616485 | rs12619285 | 1 | 0.366874 | C02 | 213558845 |
| rs12613560 | rs12619285 | 1 | 0.568966 | C02 | 213559032 |
| rs4467215 | rs12619285 | 1 | 0.568966 | C02 | 213559209 |
| rs2371786 | rs12619285 | 1 | 0.632184 | C02 | 213559439 |
| rs10932456 | rs12619285 | 1 | 0.549192 | C02 | 213561500 |
| rs4233991 | rs12619285 | 1 | 0.358901 | C02 | 213562422 |
| rs7569831 | rs12619285 | 1 | 0.350867 | C02 | 213562601 |
| rs7573040 | rs12619285 | 1 | 0.350867 | C02 | 213563109 |
| rs12470672 | rs12619285 | 1 | 0.346847 | C02 | 213563300 |
| rs13405747 | rs12619285 | 1 | 0.22366 | C02 | 213563735 |
| rs7576646 | rs12619285 | 1 | 0.496021 | C02 | 213563962 |
| rs7576850 | rs12619285 | 1 | 0.211638 | C02 | 213564116 |
| rs7603237 | rs12619285 | 1 | 0.22366 | C02 | 213564244 |
| rs7603346 | rs12619285 | 1 | 0.22366 | C02 | 213564317 |
| rs7577413 | rs12619285 | 1 | 0.331897 | C02 | 213564411 |
| rs6734978 | rs12619285 | 1 | 0.219601 | C02 | 213566314 |
| rs4673714 | rs12619285 | 1 | 0.219601 | C02 | 213566402 |
| rs12620781 | rs12619285 | 1 | 0.219601 | C02 | 213567232 |
| rs16849550 | rs12619285 | 1 | 0.219601 | C02 | 213568803 |
| rs1871946 | rs12619285 | 0.830541 | 0.319792 | C02 | 213587652 |
| rs10932460 | rs12619285 | 0.809352 | 0.292774 | C02 | 213608717 |
| rs13417169 | rs12619285 | 0.791871 | 0.270251 | C02 | 213611882 |
| rs12612034 | rs12619285 | 0.819032 | 0.290687 | C02 | 213619366 |
| rs1922291 | rs1420101 | 0.841424 | 0.200343 | C02 | 102195249 |
| rs6743219 | rs1420101 | 0.843689 | 0.205319 | C02 | 102198143 |
| rs10167431 | rs1420101 | 0.807276 | 0.249429 | C02 | 102219234 |
| rs10200410 | rs1420101 | 0.809741 | 0.239147 | C02 | 102237303 |
| rs1345301 | rs1420101 | 0.809741 | 0.239147 | C02 | 102242019 |
| rs2310243 | rs1420101 | 0.809741 | 0.239147 | C02 | 102243992 |
| rs13405355 | rs1420101 | 0.812212 | 0.24568 | C02 | 102244638 |
| rs12475055 | rs1420101 | 0.809741 | 0.239147 | C02 | 102245323 |
| rs11693697 | rs1420101 | 0.660435 | 0.235669 | C02 | 102282094 |
| rs4399750 | rs1420101 | 1 | 0.645931 | C02 | 102284220 |
| rs4090473 | rs1420101 | 1 | 0.645931 | C02 | 102289419 |
| rs11685424 | rs1420101 | 0.953846 | 0.587682 | C02 | 102293413 |
| rs1558622 | rs1420101 | 1 | 0.645931 | C02 | 102296579 |
| rs10189711 | rs1420101 | 1 | 0.645931 | C02 | 102297313 |
| rs12712135 | rs1420101 | 1 | 0.624096 | C02 | 102297380 |
| rs953934 | rs1420101 | 1 | 0.624096 | C02 | 102298725 |
| rs950880 | rs1420101 | 1 | 0.961953 | C02 | 102298994 |
| rs11123918 | rs1420101 | 1 | 0.671946 | C02 | 102301669 |
| rs10182639 | rs1420101 | 1 | 0.680256 | C02 | 102302237 |
| rs11690443 | rs1420101 | 1 | 0.680256 | C02 | 102302563 |
| rs974389 | rs1420101 | 1 | 0.645931 | C02 | 102303413 |
| rs4142132 | rs1420101 | 1 | 0.659179 | C02 | 102303914 |
| rs13001325 | rs1420101 | 1 | 0.961039 | C02 | 102305468 |
| rs1420088 | rs1420101 | 1 | 0.64268 | C02 | 102305866 |
| rs11123920 | rs1420101 | 1 | 0.639369 | C02 | 102306265 |
| rs6706844 | rs1420101 | 1 | 0.645931 | C02 | 102306844 |
| rs12996772 | rs1420101 | 1 | 0.645931 | C02 | 102313633 |
| rs1420102 | rs1420101 | 1 | 0.64268 | C02 | 102315251 |
| rs12466380 | rs1420101 | 1 | 0.64268 | C02 | 102315371 |
| rs12479210 | rs1420101 | 1 | 0.961501 | C02 | 102315593 |
| rs13019081 | rs1420101 | 1 | 0.961501 | C02 | 102317254 |
| rs1997467 | rs1420101 | 1 | 0.64268 | C02 | 102317505 |
| rs1997466 | rs1420101 | 1 | 0.64268 | C02 | 102317899 |
| rs1362350 | rs1420101 | 1 | 0.64268 | C02 | 102318230 |
| rs1362349 | rs1420101 | 1 | 0.665569 | C02 | 102318404 |
| rs17026974 | rs1420101 | 1 | 0.850885 | C02 | 102318792 |
| rs12712141 | rs1420101 | 1 | 0.662404 | C02 | 102319499 |
| rs873022 | rs1420101 | 1 | 0.850885 | C02 | 102322115 |
| rs3771177 | rs1420101 | 1 | 0.850885 | C02 | 102322292 |
| rs3732129 | rs1420101 | 1 | 0.850885 | C02 | 102323964 |
| rs1420101 | rs1420101 | 1 | 1 | C02 | 102324148 |
| rs12905 | rs1420101 | 1 | 0.850885 | C02 | 102326439 |
| rs3821204 | rs1420101 | 0.956909 | 0.812486 | C02 | 102326713 |
| rs12712142 | rs1420101 | 1 | 0.796149 | C02 | 102327016 |
| rs6543119 | rs1420101 | 1 | 0.796149 | C02 | 102329504 |
| rs13017455 | rs1420101 | 1 | 0.796149 | C02 | 102331174 |
| rs17027006 | rs1420101 | 0.956909 | 0.812486 | C02 | 102331764 |
| rs12469506 | rs1420101 | 0.958647 | 0.848874 | C02 | 102332303 |
| rs1921622 | rs1420101 | 1 | 0.39006 | C02 | 102332499 |
| rs1861245 | rs1420101 | 1 | 0.297189 | C02 | 102333338 |
| rs13424006 | rs1420101 | 1 | 0.297189 | C02 | 102333668 |
| rs6751967 | rs1420101 | 1 | 0.297189 | C02 | 102333845 |
| rs6749114 | rs1420101 | 1 | 0.297189 | C02 | 102334019 |
| rs11123923 | rs1420101 | 1 | 0.798263 | C02 | 102334276 |
| rs4988955 | rs1420101 | 1 | 0.297189 | C02 | 102334360 |
| rs4988956 | rs1420101 | 1 | 0.297189 | C02 | 102334439 |
| rs4988957 | rs1420101 | 1 | 0.297189 | C02 | 102334507 |
| rs10204137 | rs1420101 | 1 | 0.297189 | C02 | 102334644 |
| rs4988958 | rs1420101 | 1 | 0.297189 | C02 | 102334717 |
| rs10192157 | rs1420101 | 1 | 0.297189 | C02 | 102334788 |
| rs10206753 | rs1420101 | 1 | 0.297189 | C02 | 102334794 |
| rs7603730 | rs1420101 | 1 | 0.297189 | C02 | 102340803 |
| rs12998521 | rs1420101 | 1 | 0.798263 | C02 | 102340849 |
| rs10170583 | rs1420101 | 0.925939 | 0.264046 | C02 | 102341196 |
| rs10176664 | rs1420101 | 1 | 0.297189 | C02 | 102342604 |
| rs3755276 | rs1420101 | 1 | 0.297189 | C02 | 102344891 |
| rs2287037 | rs1420101 | 1 | 0.798263 | C02 | 102345460 |
| rs1362348 | rs1420101 | 1 | 0.297189 | C02 | 102351056 |
| rs3771172 | rs1420101 | 0.957414 | 0.812936 | C02 | 102352244 |
| rs3771171 | rs1420101 | 1 | 0.850885 | C02 | 102352382 |
| rs2160202 | rs1420101 | 1 | 0.846939 | C02 | 102352586 |
| rs3771166 | rs1420101 | 1 | 0.275825 | C02 | 102352654 |
| rs1974675 | rs1420101 | 1 | 0.271038 | C02 | 102352807 |
| rs10439410 | rs1420101 | 0.764681 | 0.249239 | C02 | 102357220 |
| rs6758936 | rs1420101 | 0.761508 | 0.241829 | C02 | 102357801 |
| rs2041739 | rs1420101 | 0.764681 | 0.249239 | C02 | 102360765 |
| rs17027037 | rs1420101 | 1 | 0.850885 | C02 | 102361316 |
| rs2080289 | rs1420101 | 1 | 0.850885 | C02 | 102361452 |
| rs10208196 | rs1420101 | 0.762981 | 0.245226 | C02 | 102362777 |
| rs11683700 | rs1420101 | 1 | 0.846939 | C02 | 102363237 |
| rs3213732 | rs1420101 | 0.761508 | 0.241829 | C02 | 102364711 |
| rs6760621 | rs1420101 | 0.741467 | 0.222039 | C02 | 102366384 |
| rs1035130 | rs1420101 | 1 | 0.850885 | C02 | 102367834 |
| rs2241116 | rs1420101 | 1 | 0.651264 | C02 | 102369697 |
| rs6706002 | rs1420101 | 0.761508 | 0.241829 | C02 | 102372536 |
| rs4851570 | rs1420101 | 1 | 0.850885 | C02 | 102372819 |
| rs6749014 | rs1420101 | 0.756416 | 0.241978 | C02 | 102372880 |
| rs1420097 | rs1420101 | 0.761508 | 0.241829 | C02 | 102375786 |
| rs4851004 | rs1420101 | 0.761508 | 0.241829 | C02 | 102375969 |
| rs2287034 | rs1420101 | 0.956392 | 0.812026 | C02 | 102377020 |
| rs2287033 | rs1420101 | 0.761508 | 0.241829 | C02 | 102377669 |
| rs4851005 | rs1420101 | 0.817361 | 0.446728 | C02 | 102377949 |
| rs1135354 | rs1420101 | 1 | 0.914682 | C02 | 102380734 |
| rs1420094 | rs1420101 | 0.761508 | 0.241829 | C02 | 102382119 |
| rs17027087 | rs1420101 | 1 | 0.805825 | C02 | 102382350 |
| rs6710528 | rs1420101 | 0.761508 | 0.241829 | C02 | 102382574 |
| rs3732124 | rs1420101 | 0.764162 | 0.262775 | C02 | 102384484 |
| rs3732123 | rs1420101 | 1 | 0.850885 | C02 | 102384509 |
| rs4851571 | rs1420101 | 0.761508 | 0.241829 | C02 | 102385432 |
| rs4851572 | rs1420101 | 0.761508 | 0.241829 | C02 | 102385463 |
| rs2110662 | rs1420101 | 0.761508 | 0.241829 | C02 | 102386755 |
| rs7594402 | rs1420101 | 0.761508 | 0.241829 | C02 | 102387699 |
| rs6710034 | rs1420101 | 0.761508 | 0.241829 | C02 | 102390110 |
| rs10203558 | rs1420101 | 0.762981 | 0.245226 | C02 | 102394072 |
| rs10200952 | rs1420101 | 0.755555 | 0.237129 | C02 | 102394083 |
| rs7559566 | rs1420101 | 0.747891 | 0.217623 | C02 | 102394473 |
| rs11693955 | rs1420101 | 1 | 0.850885 | C02 | 102395597 |
| rs1592458 | rs1420101 | 0.761508 | 0.241829 | C02 | 102398181 |
| rs1420105 | rs1420101 | 0.764681 | 0.249239 | C02 | 102401551 |
| rs2293224 | rs1420101 | 0.764681 | 0.249239 | C02 | 102402211 |
| rs2293225 | rs1420101 | 1 | 0.651264 | C02 | 102402321 |
| rs6743516 | rs1420101 | 0.762981 | 0.245226 | C02 | 102402767 |
| rs3771156 | rs1420101 | 1 | 0.850885 | C02 | 102403109 |
| rs1420100 | rs1420101 | 0.764681 | 0.249239 | C02 | 102403434 |

TABLE 2-continued

| surrogate marker | anchor marker | D' | r² | chromosome | position |
|---|---|---|---|---|---|
| rs3771155 | rs1420101 | 0.766212 | 0.252945 | C02 | 102404258 |
| rs10206291 | rs1420101 | 0.764681 | 0.249239 | C02 | 102405295 |
| rs885088 | rs1420101 | 0.764681 | 0.249239 | C02 | 102405476 |
| rs3771154 | rs1420101 | 0.764681 | 0.249239 | C02 | 102405792 |
| rs6759479 | rs1420101 | 0.764681 | 0.249239 | C02 | 102406479 |
| rs887972 | rs1420101 | 0.916037 | 0.772378 | C02 | 102407377 |
| rs887971 | rs1420101 | 0.916307 | 0.776311 | C02 | 102407599 |
| rs3755266 | rs1420101 | 0.761508 | 0.241829 | C02 | 102409144 |
| rs7559845 | rs1420101 | 0.761508 | 0.241829 | C02 | 102412646 |
| rs2310300 | rs1420101 | 0.761508 | 0.241829 | C02 | 102415506 |
| rs11681718 | rs1420101 | 0.957351 | 0.812829 | C02 | 102417576 |
| rs4851582 | rs1420101 | 0.957351 | 0.812829 | C02 | 102417990 |
| rs3755265 | rs1420101 | 0.759741 | 0.23786 | C02 | 102419248 |
| rs4479442 | rs1420101 | 0.757398 | 0.239226 | C02 | 102420506 |
| rs2058659 | rs1420101 | 0.761508 | 0.241829 | C02 | 102420988 |
| rs17027166 | rs1420101 | 0.957351 | 0.812829 | C02 | 102421852 |
| rs13021177 | rs1420101 | 0.761508 | 0.241829 | C02 | 102422925 |
| rs10490204 | rs1420101 | 0.957351 | 0.812829 | C02 | 102422966 |
| rs17027179 | rs1420101 | 0.957351 | 0.812829 | C02 | 102423591 |
| rs10490203 | rs1420101 | 0.957351 | 0.812829 | C02 | 102425669 |
| rs3771150 | rs1420101 | 1 | 0.850885 | C02 | 102427283 |
| rs11694360 | rs1420101 | 0.84277 | 0.707515 | C02 | 102427579 |
| rs11123928 | rs1420101 | 0.84277 | 0.707515 | C02 | 102427718 |
| rs7597017 | rs1420101 | 0.840322 | 0.672664 | C02 | 102428548 |
| rs6543135 | rs1420101 | 1 | 0.214133 | C02 | 102428838 |
| rs11465730 | rs1420101 | 0.814947 | 0.444093 | C02 | 102433290 |
| rs11690532 | rs1420101 | 0.938856 | 0.494327 | C02 | 102442858 |
| rs6705385 | rs1420101 | 0.813669 | 0.442701 | C02 | 102443001 |
| rs6705498 | rs1420101 | 0.814947 | 0.444093 | C02 | 102443102 |
| rs6719196 | rs1420101 | 0.814947 | 0.444093 | C02 | 102443320 |
| rs17027230 | rs1420101 | 0.957351 | 0.812829 | C02 | 102445762 |
| rs12463588 | rs1420101 | 0.813669 | 0.442701 | C02 | 102451689 |
| rs2310302 | rs1420101 | 0.814947 | 0.444093 | C02 | 102452481 |
| rs12469887 | rs1420101 | 0.810614 | 0.421588 | C02 | 102453190 |
| rs4140786 | rs1420101 | 0.814947 | 0.444093 | C02 | 102454608 |
| rs10201184 | rs1420101 | 0.817373 | 0.459811 | C02 | 102455510 |
| rs4851011 | rs1420101 | 0.957351 | 0.812829 | C02 | 102456110 |
| rs17027255 | rs1420101 | 0.957351 | 0.812829 | C02 | 102456559 |
| rs17027258 | rs1420101 | 0.957351 | 0.812829 | C02 | 102457972 |
| rs17775170 | rs1420101 | 0.627865 | 0.269141 | C02 | 102618359 |
| rs2335052 | rs4857855 | 1 | 0.725275 | C03 | 129687641 |
| rs13076142 | rs4857855 | 1 | 0.71223 | C03 | 129706041 |
| rs7433900 | rs4857855 | 0.756862 | 0.461744 | C03 | 129723644 |
| rs4613470 | rs4857855 | 0.716189 | 0.2349 | C03 | 129723971 |
| rs9819395 | rs4857855 | 0.767963 | 0.589767 | C03 | 129728386 |
| rs9819402 | rs4857855 | 0.85409 | 0.66657 | C03 | 129728399 |
| rs6803892 | rs4857855 | 0.934815 | 0.610489 | C03 | 129729224 |
| rs7629705 | rs4857855 | 1 | 0.665622 | C03 | 129731089 |
| rs12490685 | rs4857855 | 1 | 0.636364 | C03 | 129732149 |
| rs6439132 | rs4857855 | 1 | 0.665622 | C03 | 129732825 |
| rs4431128 | rs4857855 | 1 | 1 | C03 | 129734368 |
| rs13098445 | rs4857855 | 1 | 0.559229 | C03 | 129737754 |
| rs9854612 | rs4857855 | 1 | 0.559229 | C03 | 129739904 |
| rs4857855 | rs4857855 | 1 | 1 | C03 | 129743240 |
| rs4075158 | rs4857855 | 0.858083 | 0.386576 | C03 | 129748728 |
| rs7635061 | rs4857855 | 0.867063 | 0.403371 | C03 | 129755171 |
| rs4857907 | rs4857855 | 0.882177 | 0.696209 | C03 | 129759438 |
| rs2335050 | rs4857855 | 0.883269 | 0.733349 | C03 | 129761493 |
| rs12494136 | rs4857855 | 0.865542 | 0.411373 | C03 | 129762338 |
| rs8180032 | rs4857855 | 0.852865 | 0.391136 | C03 | 129764289 |
| rs8179973 | rs4857855 | 0.800527 | 0.34384 | C03 | 129764320 |
| rs8179974 | rs4857855 | 0.869424 | 0.695869 | C03 | 129764391 |
| rs6782023 | rs4857855 | 0.802839 | 0.360451 | C03 | 129765205 |
| rs6806253 | rs4857855 | 0.878786 | 0.728136 | C03 | 129765387 |
| rs2734040 | rs4857855 | 0.802839 | 0.360451 | C03 | 129767401 |
| rs17344939 | rs4857855 | 0.865314 | 0.622925 | C03 | 129768184 |
| rs2713589 | rs4857855 | 0.837336 | 0.47219 | C03 | 129772898 |
| rs2734046 | rs4857855 | 0.843934 | 0.535684 | C03 | 129774903 |
| rs2465354 | rs4857855 | 0.80663 | 0.374022 | C03 | 129777587 |
| rs4328821 | rs4857855 | 0.727843 | 0.316534 | C03 | 129799125 |
| rs2811493 | rs4857855 | 0.690467 | 0.250441 | C03 | 129839989 |
| rs6793907 | rs4857855 | 0.692843 | 0.251445 | C03 | 129874316 |
| rs6768737 | rs4857855 | 0.692843 | 0.251445 | C03 | 129877747 |
| rs6785206 | rs4857855 | 0.692843 | 0.251445 | C03 | 129894714 |
| rs1545169 | rs2416257 | 0.801939 | 0.220393 | C05 | 110427275 |
| rs764916 | rs2416257 | 0.80356 | 0.2209 | C05 | 110428090 |
| rs10061842 | rs2416257 | 1 | 1 | C05 | 110430754 |
| rs4304115 | rs2416257 | 1 | 1 | C05 | 110431245 |
| rs17551370 | rs2416257 | 1 | 1 | C05 | 110432084 |
| rs10062929 | rs2416257 | 1 | 1 | C05 | 110436078 |
| rs11466742 | rs2416257 | 1 | 0.224138 | C05 | 110436642 |
| rs11466749 | rs2416257 | 1 | 0.769231 | C05 | 110440484 |
| rs11466750 | rs2416257 | 1 | 1 | C05 | 110440793 |
| rs7713025 | rs2416257 | 1 | 1 | C05 | 110444122 |
| rs7723819 | rs2416257 | 1 | 0.201183 | C05 | 110455246 |
| rs7729832 | rs2416257 | 1 | 1 | C05 | 110456643 |
| rs1370964 | rs2416257 | 1 | 1 | C05 | 110457854 |
| rs1993465 | rs2416257 | 1 | 0.201183 | C05 | 110460997 |
| rs13357747 | rs2416257 | 1 | 1 | C05 | 110461290 |
| rs7705304 | rs2416257 | 1 | 1 | C05 | 110462160 |
| rs2416257 | rs2416257 | 1 | 1 | C05 | 110463389 |
| rs10038177 | rs2416257 | 1 | 0.208075 | C05 | 110464349 |
| rs10045255 | rs2416257 | 1 | 0.201183 | C05 | 110466256 |
| rs10065045 | rs2416257 | 1 | 0.224138 | C05 | 110467163 |
| rs1379300 | rs2416257 | 1 | 0.201183 | C05 | 110469338 |
| rs2034896 | rs2416257 | 1 | 0.203338 | C05 | 110469432 |
| rs10056179 | rs2416257 | 1 | 1 | C05 | 110470036 |
| rs10038058 | rs2416257 | 1 | 0.201183 | C05 | 110471180 |
| rs10039043 | rs2416257 | 1 | 0.931507 | C05 | 110472808 |
| rs2112541 | rs2416257 | 1 | 0.201183 | C05 | 110477245 |
| rs10060003 | rs2416257 | 1 | 0.201183 | C05 | 110477256 |
| rs10055177 | rs2416257 | 1 | 0.203338 | C05 | 110478483 |
| rs10051830 | rs2416257 | 1 | 0.201183 | C05 | 110480744 |
| rs11949868 | rs2416257 | 1 | 0.722222 | C05 | 110483798 |
| rs17624563 | rs2416257 | 1 | 0.722222 | C05 | 110484162 |
| rs2290680 | rs2416257 | 1 | 0.722222 | C05 | 110487846 |
| rs7702774 | rs2416257 | 1 | 0.201183 | C05 | 110488750 |
| rs11951907 | rs2416257 | 1 | 0.722222 | C05 | 110489521 |
| rs11948089 | rs2416257 | 1 | 1 | C05 | 110492292 |
| rs6869774 | rs2416257 | 1 | 1 | C05 | 110494985 |
| rs6870356 | rs2416257 | 1 | 1 | C05 | 110495136 |
| rs1438671 | rs2416257 | 1 | 0.224138 | C05 | 110495730 |
| rs7731821 | rs2416257 | 1 | 1 | C05 | 110495817 |
| rs6876020 | rs2416257 | 1 | 0.722222 | C05 | 110496246 |
| rs7714869 | rs2416257 | 1 | 1 | C05 | 110499534 |
| rs1037684 | rs2416257 | 1 | 0.441687 | C05 | 110502060 |
| rs390047 | rs2416257 | 1 | 0.38914 | C05 | 110502091 |
| rs10478039 | rs2416257 | 1 | 0.461538 | C05 | 110520485 |
| rs11745646 | rs2416257 | 1 | 0.296435 | C05 | 110521442 |
| rs9326826 | rs2416257 | 1 | 0.331984 | C05 | 110522145 |
| rs17459203 | rs2416257 | 0.680555 | 0.270767 | C05 | 110522516 |
| rs6871704 | rs2416257 | 1 | 0.405594 | C05 | 110523726 |
| rs1821908 | rs2416257 | 1 | 0.405594 | C05 | 110523970 |
| rs6876720 | rs2416257 | 1 | 0.405594 | C05 | 110524115 |
| rs10039800 | rs2416257 | 1 | 0.423077 | C05 | 110524381 |
| rs10045416 | rs2416257 | 1 | 0.423077 | C05 | 110524402 |
| rs11241104 | rs2416257 | 1 | 0.423077 | C05 | 110524618 |
| rs11241105 | rs2416257 | 1 | 0.423077 | C05 | 110524642 |
| rs10900667 | rs2416257 | 1 | 0.417476 | C05 | 110524755 |
| rs10900668 | rs2416257 | 1 | 0.42029 | C05 | 110524867 |
| rs11241107 | rs2416257 | 1 | 0.423077 | C05 | 110524998 |
| rs10080189 | rs2416257 | 1 | 0.331984 | C05 | 110525362 |
| rs6888381 | rs2416257 | 1 | 0.423077 | C05 | 110526313 |
| rs10054378 | rs2416257 | 1 | 0.423077 | C05 | 110527038 |
| rs10062374 | rs2416257 | 1 | 0.423077 | C05 | 110527135 |
| rs7720082 | rs2416257 | 1 | 0.423077 | C05 | 110528123 |
| rs10073900 | rs2416257 | 1 | 0.42029 | C05 | 110529681 |
| rs10060762 | rs2416257 | 1 | 0.423077 | C05 | 110529943 |
| rs1428644 | rs2416257 | 1 | 0.331984 | C05 | 110530041 |
| rs6892420 | rs2416257 | 1 | 0.42029 | C05 | 110530511 |
| rs11959067 | rs2416257 | 1 | 0.331984 | C05 | 110530604 |
| rs10063014 | rs2416257 | 1 | 0.423077 | C05 | 110531277 |
| rs1072056 | rs2416257 | 1 | 0.423077 | C05 | 110532014 |
| rs10040556 | rs2416257 | 0.922272 | 0.796495 | C05 | 110532311 |
| rs9326828 | rs2416257 | 1 | 0.455959 | C05 | 110533787 |
| rs17460372 | rs2416257 | 1 | 0.685315 | C05 | 110551686 |
| rs4957929 | rs2416257 | 1 | 0.331984 | C05 | 110552362 |
| rs436398 | rs2416257 | 0.668305 | 0.248422 | C05 | 110559325 |
| rs244517 | rs2416257 | 1 | 0.331984 | C05 | 110561978 |
| rs12518040 | rs2416257 | 1 | 0.331984 | C05 | 110563310 |
| rs10477464 | rs2416257 | 1 | 0.685315 | C05 | 110564411 |
| rs184941 | rs2416257 | 1 | 0.405594 | C05 | 110567791 |

TABLE 2-continued

| surrogate marker | anchor marker | D' | r² | chromosome | position |
|---|---|---|---|---|---|
| rs1469441 | rs2416257 | 0.831964 | 0.581435 | C05 | 110573038 |
| rs919334 | rs2416257 | 1 | 0.25641 | C05 | 110581301 |
| rs162892 | rs4143832 | 0.672266 | 0.201867 | C05 | 131651149 |
| rs270607 | rs4143832 | 0.687885 | 0.254743 | C05 | 131677085 |
| rs270606 | rs4143832 | 0.689196 | 0.257589 | C05 | 131678766 |
| rs156322 | rs4143832 | 0.689196 | 0.257589 | C05 | 131681824 |
| rs270601 | rs4143832 | 0.689196 | 0.257589 | C05 | 131684896 |
| rs273916 | rs4143832 | 0.691306 | 0.266301 | C05 | 131687729 |
| rs273915 | rs4143832 | 0.689196 | 0.257589 | C05 | 131688018 |
| rs273912 | rs4143832 | 0.689196 | 0.257589 | C05 | 131689248 |
| rs273911 | rs4143832 | 0.688653 | 0.255425 | C05 | 131689425 |
| rs272892 | rs4143832 | 0.692331 | 0.27071 | C05 | 131692248 |
| rs272888 | rs4143832 | 0.692331 | 0.27071 | C05 | 131693322 |
| rs272887 | rs4143832 | 0.691306 | 0.266301 | C05 | 131693612 |
| rs272883 | rs4143832 | 0.689196 | 0.257589 | C05 | 131696597 |
| rs272882 | rs4143832 | 0.689196 | 0.257589 | C05 | 131697060 |
| rs272880 | rs4143832 | 0.689196 | 0.257589 | C05 | 131698077 |
| rs272878 | rs4143832 | 0.689196 | 0.257589 | C05 | 131699668 |
| rs272872 | rs4143832 | 0.689196 | 0.257589 | C05 | 131703763 |
| rs272868 | rs4143832 | 0.683929 | 0.250169 | C05 | 131708650 |
| rs273901 | rs4143832 | 0.689196 | 0.257589 | C05 | 131722259 |
| rs2631372 | rs4143832 | 0.689196 | 0.257589 | C05 | 131731477 |
| rs2631362 | rs4143832 | 0.689196 | 0.257589 | C05 | 131735192 |
| rs671473 | rs4143832 | 0.689196 | 0.257589 | C05 | 131736434 |
| rs183898 | rs4143832 | 0.659203 | 0.225269 | C05 | 131744801 |
| rs17771891 | rs4143832 | 0.664804 | 0.354792 | C05 | 131772101 |
| rs1016988 | rs4143832 | 0.667129 | 0.356148 | C05 | 131772473 |
| rs7704457 | rs4143832 | 0.667129 | 0.356148 | C05 | 131772689 |
| rs1003533 | rs4143832 | 0.61165 | 0.323815 | C05 | 131783550 |
| rs1981524 | rs4143832 | 0.61165 | 0.323815 | C05 | 131784405 |
| rs10900807 | rs4143832 | 0.61165 | 0.323815 | C05 | 131785379 |
| rs2106854 | rs4143832 | 0.635922 | 0.376949 | C05 | 131797073 |
| rs6874639 | rs4143832 | 0.635922 | 0.376949 | C05 | 131806615 |
| rs7730247 | rs4143832 | 0.635922 | 0.376949 | C05 | 131809187 |
| rs1012793 | rs4143832 | 0.631452 | 0.37299 | C05 | 131809244 |
| rs2706383 | rs4143832 | 0.586011 | 0.340617 | C05 | 131820301 |
| rs2405528 | rs4143832 | 0.588571 | 0.345025 | C05 | 131822197 |
| rs886286 | rs4143832 | 0.588806 | 0.346693 | C05 | 131823496 |
| rs757105 | rs4143832 | 0.588571 | 0.345025 | C05 | 131823562 |
| rs2522047 | rs4143832 | 0.588806 | 0.346693 | C05 | 131823781 |
| rs2522050 | rs4143832 | 0.588571 | 0.345025 | C05 | 131824508 |
| rs2706395 | rs4143832 | 0.588332 | 0.343335 | C05 | 131824702 |
| rs2522054 | rs4143832 | 0.588806 | 0.346693 | C05 | 131827425 |
| rs2706339 | rs4143832 | 0.614458 | 0.348893 | C05 | 131828004 |
| rs2522056 | rs4143832 | 0.588571 | 0.345025 | C05 | 131829625 |
| rs2706373 | rs4143832 | 0.588087 | 0.341624 | C05 | 131832155 |
| rs2522062 | rs4143832 | 0.588806 | 0.346693 | C05 | 131833315 |
| rs2522063 | rs4143832 | 0.588806 | 0.346693 | C05 | 131833490 |
| rs2706379 | rs4143832 | 0.588806 | 0.346693 | C05 | 131833634 |
| rs2522064 | rs4143832 | 0.633476 | 0.383119 | C05 | 131834387 |
| rs2057655 | rs4143832 | 0.588806 | 0.346693 | C05 | 131835523 |
| rs2706381 | rs4143832 | 0.588332 | 0.343335 | C05 | 131838518 |
| rs4705952 | rs4143832 | 1 | 0.82231 | C05 | 131867517 |
| rs2706390 | rs4143832 | 1 | 1 | C05 | 131870179 |
| rs4143832 | rs4143832 | 1 | 1 | C05 | 131890876 |
| rs763595 | rs4143832 | 1 | 1 | C05 | 131891143 |
| rs2079103 | rs4143832 | 1 | 0.627184 | C05 | 131892405 |
| rs17690122 | rs4143832 | 1 | 1 | C05 | 131895734 |
| rs743562 | rs4143832 | 1 | 0.260204 | C05 | 131900282 |
| rs12652920 | rs4143832 | 0.848434 | 0.427271 | C05 | 131913139 |
| rs2706338 | rs4143832 | 0.848622 | 0.429729 | C05 | 131923748 |
| rs2244012 | rs4143832 | 0.848622 | 0.429729 | C05 | 131929124 |
| rs2299015 | rs4143832 | 0.840183 | 0.434252 | C05 | 131929396 |
| rs2706347 | rs4143832 | 0.848434 | 0.427271 | C05 | 131933016 |
| rs2706348 | rs4143832 | 0.848622 | 0.429729 | C05 | 131933709 |
| rs17166050 | rs4143832 | 0.848622 | 0.429729 | C05 | 131943112 |
| rs2522403 | rs4143832 | 0.848622 | 0.429729 | C05 | 131943216 |
| rs2246176 | rs4143832 | 0.850167 | 0.451078 | C05 | 131945249 |
| rs2252775 | rs4143832 | 0.848622 | 0.429729 | C05 | 131946343 |
| rs10463893 | rs4143832 | 0.848434 | 0.427271 | C05 | 131955938 |
| rs2897443 | rs4143832 | 0.848622 | 0.429729 | C05 | 131957493 |
| rs17622991 | rs4143832 | 0.848622 | 0.429729 | C05 | 131960652 |
| rs2706370 | rs4143832 | 0.848047 | 0.422271 | C05 | 131960915 |
| rs2706372 | rs4143832 | 0.849073 | 0.449915 | C05 | 131963376 |
| rs6884762 | rs4143832 | 1 | 0.318885 | C05 | 131966629 |
| rs12187537 | rs4143832 | 0.841147 | 0.433951 | C05 | 131967803 |
| rs2522394 | rs4143832 | 0.848622 | 0.429729 | C05 | 131972028 |
| rs10520114 | rs4143832 | 0.848622 | 0.429729 | C05 | 131976790 |
| rs2301713 | rs4143832 | 0.848243 | 0.424785 | C05 | 131979895 |
| rs6596086 | rs4143832 | 0.848622 | 0.429729 | C05 | 131980121 |
| rs2106984 | rs4143832 | 0.848622 | 0.429729 | C05 | 131980965 |
| rs7449456 | rs4143832 | 0.849823 | 0.446158 | C05 | 131981326 |
| rs3798135 | rs4143832 | 0.848622 | 0.429729 | C05 | 131993008 |
| rs3798134 | rs4143832 | 0.848434 | 0.427271 | C05 | 131993078 |
| rs6596087 | rs4143832 | 0.836254 | 0.417703 | C05 | 131996508 |
| rs6871536 | rs4143832 | 0.848622 | 0.429729 | C05 | 131997773 |
| rs12653750 | rs4143832 | 0.848622 | 0.429729 | C05 | 131999801 |
| rs2040703 | rs4143832 | 0.848243 | 0.424785 | C05 | 132000157 |
| rs2040704 | rs4143832 | 0.848622 | 0.429729 | C05 | 132001076 |
| rs2074369 | rs4143832 | 0.848243 | 0.424785 | C05 | 132001562 |
| rs7737470 | rs4143832 | 0.848622 | 0.429729 | C05 | 132001962 |
| rs2240032 | rs4143832 | 0.849997 | 0.448633 | C05 | 132005026 |
| rs2158177 | rs4143832 | 0.62746 | 0.270741 | C05 | 132011957 |
| rs3091307 | rs4143832 | 0.848622 | 0.429729 | C05 | 132017035 |
| rs2844477 | rs2269426 | 0.568734 | 0.258205 | C06 | 31686751 |
| rs2857697 | rs2269426 | 0.607406 | 0.284082 | C06 | 31693198 |
| rs2857694 | rs2269426 | 0.588717 | 0.266919 | C06 | 31695849 |
| rs2857693 | rs2269426 | 0.607406 | 0.284082 | C06 | 31696363 |
| rs2844472 | rs2269426 | 0.568734 | 0.258205 | C06 | 31697655 |
| rs2736172 | rs2269426 | 0.568734 | 0.258205 | C06 | 31698877 |
| rs2260000 | rs2269426 | 0.568734 | 0.258205 | C06 | 31701455 |
| rs2736171 | rs2269426 | 0.607406 | 0.284082 | C06 | 31703466 |
| rs2736155 | rs2269426 | 0.705472 | 0.290127 | C06 | 31713178 |
| rs1077393 | rs2269426 | 0.705472 | 0.290127 | C06 | 31718508 |
| rs1052486 | rs2269426 | 0.691729 | 0.279809 | C06 | 31718665 |
| rs494620 | rs2269426 | 0.546653 | 0.214299 | C06 | 31946692 |
| rs3130481 | rs2269426 | 0.570125 | 0.202858 | C06 | 31947735 |
| rs614549 | rs2269426 | 0.514288 | 0.244882 | C06 | 31948604 |
| rs2736428 | rs2269426 | 0.470218 | 0.204766 | C06 | 31951903 |
| rs2844458 | rs2269426 | 0.57836 | 0.2755 | C06 | 31959448 |
| rs7887 | rs2269426 | 0.494318 | 0.225703 | C06 | 31972526 |
| rs2763982 | rs2269426 | 0.486545 | 0.218661 | C06 | 31980530 |
| rs644045 | rs2269426 | 1 | 0.26747 | C06 | 31991936 |
| rs2734335 | rs2269426 | 0.611501 | 0.217984 | C06 | 32001923 |
| rs3020644 | rs2269426 | 0.510449 | 0.24124 | C06 | 32002605 |
| rs537160 | rs2269426 | 0.924071 | 0.236625 | C06 | 32024379 |
| rs4151657 | rs2269426 | 0.482828 | 0.233123 | C06 | 32025519 |
| rs2072633 | rs2269426 | 0.870973 | 0.276683 | C06 | 32027557 |
| rs2072632 | rs2269426 | 0.541145 | 0.25409 | C06 | 32029454 |
| rs630379 | rs2269426 | 1 | 0.244796 | C06 | 32030233 |
| rs440454 | rs2269426 | 1 | 0.240037 | C06 | 32035321 |
| rs2280774 | rs2269426 | 0.537827 | 0.267184 | C06 | 32036670 |
| rs419788 | rs2269426 | 1 | 0.240037 | C06 | 32036778 |
| rs437179 | rs2269426 | 1 | 0.240037 | C06 | 32036993 |
| rs592229 | rs2269426 | 0.941518 | 0.382211 | C06 | 32038420 |
| rs410851 | rs2269426 | 1 | 0.249278 | C06 | 32044647 |
| rs6941112 | rs2269426 | 0.627398 | 0.321092 | C06 | 32054593 |
| rs389883 | rs2269426 | 1 | 0.248944 | C06 | 32055439 |
| rs6474 | rs2269426 | 0.599284 | 0.305589 | C06 | 32114865 |
| rs12525076 | rs2269426 | 0.931103 | 0.276052 | C06 | 32115438 |
| rs17421133 | rs2269426 | 0.628306 | 0.321384 | C06 | 32118251 |
| rs1009382 | rs2269426 | 1 | 0.277108 | C06 | 32134085 |
| rs12198173 | rs2269426 | 1 | 0.203931 | C06 | 32134786 |
| rs2239689 | rs2269426 | 0.557784 | 0.277349 | C06 | 32138262 |
| rs204883 | rs2269426 | 0.870396 | 0.583335 | C06 | 32140721 |
| rs7766862 | rs2269426 | 0.555915 | 0.271353 | C06 | 32140985 |
| rs2071295 | rs2269426 | 0.596771 | 0.303031 | C06 | 32146678 |
| rs12211410 | rs2269426 | 1 | 0.226382 | C06 | 32157401 |
| rs185819 | rs2269426 | 1 | 0.582947 | C06 | 32158045 |
| rs2071293 | rs2269426 | 0.596771 | 0.303031 | C06 | 32170665 |
| rs17421624 | rs2269426 | 0.596771 | 0.303031 | C06 | 32174155 |
| rs13199524 | rs2269426 | 1 | 0.203931 | C06 | 32174743 |
| rs12153855 | rs2269426 | 1 | 0.272544 | C06 | 32182782 |
| rs429150 | rs2269426 | 0.958418 | 0.760464 | C06 | 32183541 |
| rs2269426 | rs2269426 | 1 | 1 | C06 | 32184477 |
| rs8111 | rs2269426 | 1 | 0.560811 | C06 | 32191153 |
| rs9391734 | rs2269426 | 1 | 0.289532 | C06 | 32205961 |
| rs9267803 | rs2269426 | 1 | 0.560811 | C06 | 32209740 |
| rs4713505 | rs2269426 | 1 | 0.560811 | C06 | 32212979 |
| rs4713506 | rs2269426 | 1 | 0.531903 | C06 | 32221958 |
| rs1053924 | rs2269426 | 1 | 0.364732 | C06 | 32228693 |
| rs3134950 | rs2269426 | 0.947931 | 0.457793 | C06 | 32235455 |

TABLE 2-continued

| surrogate marker | anchor marker | D' | r² | chromosome | position |
|---|---|---|---|---|---|
| rs2269424 | rs2269426 | 0.916025 | 0.332172 | C06 | 32240211 |
| rs1061808 | rs2269426 | 0.897346 | 0.424223 | C06 | 32244525 |
| rs1061807 | rs2269426 | 0.916025 | 0.332172 | C06 | 32244816 |
| rs2269423 | rs2269426 | 0.897346 | 0.424223 | C06 | 32253685 |
| rs1035798 | rs2269426 | 0.916025 | 0.332172 | C06 | 32259200 |
| rs1800624 | rs2269426 | 0.836383 | 0.295681 | C06 | 32260365 |
| rs2071280 | rs2269426 | 0.66839 | 0.290949 | C06 | 32272847 |
| rs2071279 | rs2269426 | 0.717188 | 0.329274 | C06 | 32272852 |
| rs9267820 | rs2269426 | 0.655661 | 0.251406 | C06 | 32273561 |
| rs9267821 | rs2269426 | 0.665133 | 0.289162 | C06 | 32277552 |
| rs2071287 | rs2269426 | 0.62681 | 0.272032 | C06 | 32278411 |
| rs2071277 | rs2269426 | 0.62681 | 0.272032 | C06 | 32279661 |
| rs9267833 | rs2269426 | 0.66839 | 0.290949 | C06 | 32285878 |
| rs2071286 | rs2269426 | 0.686812 | 0.26454 | C06 | 32287874 |
| rs3134799 | rs2269426 | 0.691808 | 0.32146 | C06 | 32292199 |
| rs3134798 | rs2269426 | 0.935285 | 0.298199 | C06 | 32292683 |
| rs436388 | rs2269426 | 0.767869 | 0.322591 | C06 | 32294242 |
| rs444472 | rs2269426 | 0.57282 | 0.258136 | C06 | 32294704 |
| rs394657 | rs2269426 | 0.592068 | 0.260445 | C06 | 32295001 |
| rs4429853 | rs2269426 | 0.58508 | 0.245487 | C06 | 32295180 |
| rs431722 | rs2269426 | 0.793218 | 0.331481 | C06 | 32295700 |
| rs430916 | rs2269426 | 0.654276 | 0.26561 | C06 | 32296077 |
| rs423023 | rs2269426 | 0.733107 | 0.457304 | C06 | 32296275 |
| rs422951 | rs2269426 | 0.551882 | 0.234519 | C06 | 32296361 |
| rs520803 | rs2269426 | 0.729036 | 0.465751 | C06 | 32296581 |
| rs520692 | rs2269426 | 0.727926 | 0.446988 | C06 | 32296618 |
| rs415929 | rs2269426 | 0.733107 | 0.457304 | C06 | 32297010 |
| rs45855 | rs2269426 | 0.733107 | 0.457304 | C06 | 32297459 |
| rs7772031 | rs9494145 | 0.817464 | 0.204629 | C06 | 135301427 |
| rs7754722 | rs9494145 | 0.816562 | 0.213236 | C06 | 135301996 |
| rs11758774 | rs9494145 | 0.8209 | 0.215491 | C06 | 135425482 |
| rs1547247 | rs9494145 | 0.788225 | 0.314304 | C06 | 135432529 |
| rs9376090 | rs9494145 | 0.808029 | 0.470173 | C06 | 135452921 |
| rs7775698 | rs9494145 | 0.865656 | 0.542497 | C06 | 135460328 |
| rs7776054 | rs9494145 | 0.86433 | 0.517245 | C06 | 135460609 |
| rs9399137 | rs9494145 | 0.870968 | 0.522581 | C06 | 135460711 |
| rs9389268 | rs9494145 | 0.870968 | 0.522581 | C06 | 135461324 |
| rs11759553 | rs9494145 | 0.935188 | 0.602487 | C06 | 135463989 |
| rs9373124 | rs9494145 | 0.871608 | 0.547147 | C06 | 135464902 |
| rs4895440 | rs9494145 | 1 | 0.657143 | C06 | 135468251 |
| rs4895441 | rs9494145 | 1 | 0.688889 | C06 | 135468266 |
| rs9376092 | rs9494145 | 1 | 0.654676 | C06 | 135468837 |
| rs9389269 | rs9494145 | 1 | 0.686567 | C06 | 135468852 |
| rs9402686 | rs9494145 | 0.935917 | 0.633373 | C06 | 135469510 |
| rs10484494 | rs9494145 | 1 | 0.263158 | C06 | 135471786 |
| rs6920211 | rs9494145 | 1 | 0.8 | C06 | 135473011 |
| rs11154 | rs9494145 | 1 | 0.843478 | C06 | 135473333 |
| rs9494145 | rs9494145 | 1 | 1 | C06 | 135474245 |
| rs7766963 | rs9494145 | 1 | 0.295139 | C06 | 135474576 |
| rs9483788 | rs9494145 | 1 | 0.889908 | C06 | 135477194 |
| rs2026937 | rs9494145 | 0.910886 | 0.224511 | C06 | 135480956 |
| rs6934903 | rs9494145 | 0.907692 | 0.500503 | C06 | 135493257 |
| rs6569992 | rs9494145 | 0.898807 | 0.508487 | C06 | 135493845 |
| rs9389272 | rs9494145 | 0.906198 | 0.499294 | C06 | 135501530 |
| rs17064262 | rs9494145 | 0.899075 | 0.449495 | C06 | 135507167 |
| rs6924687 | rs9494145 | 0.9 | 0.45 | C06 | 135509214 |
| rs9494154 | rs9494145 | 0.9 | 0.45 | C06 | 135509698 |
| rs17706858 | rs9494145 | 0.8 | 0.355556 | C06 | 135526787 |
| rs7757054 | rs9494145 | 0.7 | 0.272222 | C06 | 135529307 |
| rs11965277 | rs9494145 | 0.76 | 0.262545 | C06 | 135539525 |
| rs1022506 | rs9494145 | 0.76 | 0.262545 | C06 | 135553280 |
| rs11154794 | rs9494145 | 0.76 | 0.262545 | C06 | 135557141 |
| rs12663543 | rs9494145 | 0.767821 | 0.280928 | C06 | 135559307 |
| rs12660713 | rs9494145 | 0.76 | 0.262545 | C06 | 135559689 |
| rs6920829 | rs9494145 | 0.76 | 0.262545 | C06 | 135561193 |
| rs3752383 | rs9494145 | 0.858244 | 0.300534 | C06 | 135564448 |
| rs6936293 | rs9494145 | 0.76 | 0.262545 | C06 | 135577714 |
| rs7738267 | rs9494145 | 0.672727 | 0.228357 | C06 | 135578886 |
| rs10095228 | rs748065 | 0.830888 | 0.486122 | C08 | 21724187 |
| rs17427894 | rs748065 | 1 | 0.245283 | C08 | 21728250 |
| rs10096540 | rs748065 | 0.90944 | 0.56481 | C08 | 21729036 |
| rs17060577 | rs748065 | 1 | 0.440353 | C08 | 21729708 |
| rs17615281 | rs748065 | 1 | 0.245283 | C08 | 21730683 |
| rs10107501 | rs748065 | 0.89993 | 0.549939 | C08 | 21731204 |
| rs17060585 | rs748065 | 1 | 1 | C08 | 21733604 |
| rs748065 | rs748065 | 1 | 1 | C08 | 21734049 |
| rs7014068 | rs748065 | 1 | 1 | C08 | 21736295 |
| rs10107278 | rs748065 | 1 | 1 | C08 | 21737035 |
| rs922504 | rs748065 | 1 | 0.636364 | C08 | 21737990 |
| rs4872494 | rs748065 | 1 | 0.964222 | C08 | 21747560 |
| rs4872500 | rs748065 | 1 | 0.615385 | C08 | 21748400 |
| rs17060602 | rs748065 | 1 | 0.897436 | C08 | 21749167 |
| rs7464201 | rs748065 | 1 | 0.64018 | C08 | 21749954 |
| rs369756 | rs3939286 | 0.714032 | 0.287121 | C09 | 6136441 |
| rs450108 | rs3939286 | 1 | 0.435398 | C09 | 6143485 |
| rs1116795 | rs3939286 | 1 | 0.503722 | C09 | 6145226 |
| rs2225537 | rs3939286 | 1 | 0.490446 | C09 | 6150578 |
| rs10124250 | rs3939286 | 1 | 0.503722 | C09 | 6151686 |
| rs10119713 | rs3939286 | 1 | 0.503722 | C09 | 6153823 |
| rs2079 | rs3939286 | 0.514984 | 0.214206 | C09 | 6156653 |
| rs2381413 | rs3939286 | 1 | 0.471154 | C09 | 6157017 |
| rs7032572 | rs3939286 | 1 | 0.503876 | C09 | 6162380 |
| rs10815362 | rs3939286 | 0.904609 | 0.249384 | C09 | 6163798 |
| rs2890704 | rs3939286 | 0.907589 | 0.252485 | C09 | 6174165 |
| rs1929996 | rs3939286 | 1 | 0.728507 | C09 | 6177636 |
| rs10758748 | rs3939286 | 1 | 0.285714 | C09 | 6177862 |
| rs4742166 | rs3939286 | 1 | 0.72561 | C09 | 6178124 |
| rs1412426 | rs3939286 | 1 | 0.728507 | C09 | 6178652 |
| rs1412425 | rs3939286 | 1 | 0.72561 | C09 | 6178740 |
| rs1342326 | rs3939286 | 1 | 0.513678 | C09 | 6180076 |
| rs2095044 | rs3939286 | 1 | 0.964222 | C09 | 6182796 |
| rs2381416 | rs3939286 | 1 | 0.93007 | C09 | 6183455 |
| rs10815370 | rs3939286 | 1 | 0.680697 | C09 | 6184831 |
| rs1888909 | rs3939286 | 1 | 0.964222 | C09 | 6187392 |
| rs2150970 | rs3939286 | 0.907589 | 0.252485 | C09 | 6191364 |
| rs7046661 | rs3939286 | 1 | 0.680697 | C09 | 6199199 |
| rs992969 | rs3939286 | 1 | 1 | C09 | 6199697 |
| rs3939286 | rs3939286 | 1 | 1 | C09 | 6200099 |
| rs928413 | rs3939286 | 1 | 1 | C09 | 6203387 |
| rs7848215 | rs3939286 | 1 | 0.93007 | C09 | 6203468 |
| rs2066362 | rs3939286 | 0.881657 | 0.399291 | C09 | 6209176 |
| rs12339348 | rs3939286 | 0.60752 | 0.249249 | C09 | 6223082 |
| rs17582919 | rs3939286 | 0.603368 | 0.245854 | C09 | 6223376 |
| rs10975507 | rs3939286 | 0.60752 | 0.249249 | C09 | 6226977 |
| rs17498196 | rs3939286 | 0.60752 | 0.249249 | C09 | 6227547 |
| rs10815393 | rs3939286 | 0.60752 | 0.249249 | C09 | 6230324 |
| rs7019575 | rs3939286 | 0.741062 | 0.27663 | C09 | 6233935 |
| rs744567 | rs3939286 | 0.562538 | 0.213706 | C09 | 6282602 |
| rs4742211 | rs3939286 | 0.641365 | 0.223294 | C09 | 6525500 |
| rs2106409 | rs3184504 | 0.598939 | 0.271257 | C12 | 109870381 |
| rs4766521 | rs3184504 | 0.69865 | 0.304042 | C12 | 109871344 |
| rs3919447 | rs3184504 | 0.652019 | 0.306966 | C12 | 109876182 |
| rs4766522 | rs3184504 | 0.600811 | 0.275346 | C12 | 109877902 |
| rs2106407 | rs3184504 | 0.598939 | 0.271257 | C12 | 109878710 |
| rs2106406 | rs3184504 | 0.600811 | 0.275346 | C12 | 109878767 |
| rs12425190 | rs3184504 | 0.600811 | 0.275346 | C12 | 109879312 |
| rs2339706 | rs3184504 | 0.600811 | 0.275346 | C12 | 109880802 |
| rs4509829 | rs3184504 | 0.600811 | 0.275346 | C12 | 109880996 |
| rs11838131 | rs3184504 | 0.600811 | 0.275346 | C12 | 109881341 |
| rs12818548 | rs3184504 | 0.663295 | 0.311195 | C12 | 109882481 |
| rs4766523 | rs3184504 | 0.598939 | 0.271257 | C12 | 109883562 |
| rs4766524 | rs3184504 | 0.597304 | 0.272141 | C12 | 109883829 |
| rs7961663 | rs3184504 | 0.600811 | 0.275346 | C12 | 109884154 |
| rs7961935 | rs3184504 | 0.600811 | 0.275346 | C12 | 109884389 |
| rs7978821 | rs3184504 | 0.600811 | 0.275346 | C12 | 109884499 |
| rs4766526 | rs3184504 | 0.667865 | 0.318268 | C12 | 109885699 |
| rs4766442 | rs3184504 | 0.600811 | 0.275346 | C12 | 109886076 |
| rs4766443 | rs3184504 | 0.549529 | 0.230041 | C12 | 109886181 |
| rs12815195 | rs3184504 | 0.600811 | 0.275346 | C12 | 109886746 |
| rs4766527 | rs3184504 | 0.600811 | 0.275346 | C12 | 109889853 |
| rs12814105 | rs3184504 | 0.661611 | 0.314137 | C12 | 109891219 |
| rs991817 | rs3184504 | 0.600811 | 0.275346 | C12 | 109894920 |
| rs11065784 | rs3184504 | 0.667865 | 0.318268 | C12 | 109896846 |
| rs7968960 | rs3184504 | 0.63855 | 0.343686 | C12 | 109910998 |
| rs4378452 | rs3184504 | 0.663217 | 0.360651 | C12 | 109988416 |
| rs10774613 | rs3184504 | 0.550714 | 0.2646 | C12 | 110030548 |
| rs1265566 | rs3184504 | 0.867628 | 0.259762 | C12 | 110200759 |
| rs7970490 | rs3184504 | 0.848231 | 0.221355 | C12 | 110240821 |
| rs3847953 | rs3184504 | 0.924784 | 0.263113 | C12 | 110249847 |
| rs6490055 | rs3184504 | 0.911843 | 0.208663 | C12 | 110253356 |
| rs11065884 | rs3184504 | 1 | 0.240386 | C12 | 110303084 |
| rs10849944 | rs3184504 | 1 | 0.240386 | C12 | 110309772 |

TABLE 2-continued

| surrogate marker | anchor marker | D' | $r^2$ | chromosome | position |
|---|---|---|---|---|---|
| rs7302763 | rs3184504 | 1 | 0.243781 | C12 | 110311952 |
| rs10849946 | rs3184504 | 1 | 0.240386 | C12 | 110314868 |
| rs4766573 | rs3184504 | 1 | 0.240386 | C12 | 110315192 |
| rs10774623 | rs3184504 | 1 | 0.240386 | C12 | 110317972 |
| rs12580300 | rs3184504 | 1 | 0.219935 | C12 | 110333654 |
| rs11065898 | rs3184504 | 1 | 0.25096 | C12 | 110346958 |
| rs10849947 | rs3184504 | 1 | 0.236063 | C12 | 110349067 |
| rs2283358 | rs3184504 | 1 | 0.219935 | C12 | 110349948 |
| rs7296313 | rs3184504 | 1 | 0.230047 | C12 | 110362909 |
| rs2239195 | rs3184504 | 1 | 0.23445 | C12 | 110365692 |
| rs2238154 | rs3184504 | 1 | 0.219935 | C12 | 110366868 |
| rs3184504 | rs3184504 | 1 | 1 | C12 | 110368991 |
| rs739496 | rs3184504 | 1 | 0.230047 | C12 | 110372042 |
| rs10849949 | rs3184504 | 1 | 0.219935 | C12 | 110377920 |
| rs2073950 | rs3184504 | 1 | 0.219935 | C12 | 110378455 |
| rs2301622 | rs3184504 | 1 | 0.222294 | C12 | 110379586 |
| rs2301621 | rs3184504 | 1 | 0.219935 | C12 | 110379655 |
| rs4766578 | rs3184504 | 1 | 0.965238 | C12 | 110388754 |
| rs10774625 | rs3184504 | 1 | 0.965961 | C12 | 110394602 |
| rs2339816 | rs3184504 | 1 | 0.218055 | C12 | 110396571 |
| rs1029388 | rs3184504 | 1 | 0.219935 | C12 | 110411284 |
| rs6490162 | rs3184504 | 1 | 0.219935 | C12 | 110425503 |
| rs628825 | rs3184504 | 1 | 0.200363 | C12 | 110436233 |
| rs630512 | rs3184504 | 1 | 0.200363 | C12 | 110436550 |
| rs688812 | rs3184504 | 1 | 0.204072 | C12 | 110446964 |
| rs657197 | rs3184504 | 1 | 0.201774 | C12 | 110450041 |
| rs607316 | rs3184504 | 1 | 0.200363 | C12 | 110453831 |
| rs616668 | rs3184504 | 1 | 0.200363 | C12 | 110458663 |
| rs648997 | rs3184504 | 1 | 0.370996 | C12 | 110461159 |
| rs625093 | rs3184504 | 1 | 0.200363 | C12 | 110472815 |
| rs638791 | rs3184504 | 1 | 0.200363 | C12 | 110473619 |
| rs593226 | rs3184504 | 1 | 0.319821 | C12 | 110478269 |
| rs616559 | rs3184504 | 1 | 0.204072 | C12 | 110487733 |
| rs616513 | rs3184504 | 1 | 0.200363 | C12 | 110487766 |
| rs653178 | rs3184504 | 1 | 1 | C12 | 110492139 |
| rs12369009 | rs3184504 | 1 | 0.200363 | C12 | 110504182 |
| rs695871 | rs3184504 | 0.914919 | 0.219128 | C12 | 110521383 |
| rs11065987 | rs3184504 | 0.958507 | 0.690892 | C12 | 110556807 |
| rs601663 | rs3184504 | 0.793576 | 0.226059 | C12 | 110607667 |
| rs2238151 | rs3184504 | 0.825316 | 0.292216 | C12 | 110696216 |
| rs10744777 | rs3184504 | 0.825316 | 0.292216 | C12 | 110717401 |

In a specific embodiment, the marker in LD is a genotyped surrogate marker with $r^2>0.2$ to the anchor marker. For example, the marker in LD may be a surrogate of Table 1. Thus, for example, surrogate markers for marker rs12619285 may suitably be selected from the group consisting of rs12617902, rs4672665, rs16849446, rs975381, rs2170572, rs7560454, rs12619285, rs10189498, rs6750754, rs6740906, rs1482577, rs13022407, rs10199053, rs17276404, rs7588793, rs12616485, rs12613560, rs4467215, rs2371786, rs10932456, rs4233991, rs7569831, rs7573040, rs12470672, rs13405747, rs7576646, rs7576850, rs7603237, rs7603346, rs7577413, rs6734978, rs4673714, rs12620781, rs16849550, rs1871946, rs10932460, rs13417169, rs12612034, which are the surrogate markers of rs12619285 listed in Table 2. Surrogate markers of other anchor markers (i.e., rs12619285, rs1420101, rs4857855, rs2416257, rs4143832, rs2269426, rs9494145, rs748065, rs3939286, and rs3184504) may be selected in an analogous fashion.

Determination of Haplotype Frequency

The frequencies of haplotypes in patient and control groups can be estimated using an expectation-maximization algorithm (Dempster A. et al., *J. R. Stat. Soc. B,* 39:1-38 (1977)). An implementation of this algorithm that can handle missing genotypes and uncertainty with the phase can be used. Under the null hypothesis, the patients and the controls are assumed to have identical frequencies. Using a likelihood approach, an alternative hypothesis is tested, where a candidate at-risk haplotype, which can include the markers described herein, is allowed to have a higher frequency in patients than controls, while the ratios of the frequencies of other haplotypes are assumed to be the same in both groups. Likelihoods are maximized separately under both hypotheses and a corresponding 1-df likelihood ratio statistic is used to evaluate the statistical significance.

To look for at-risk and protective markers and haplotypes within a susceptibility region, for example within an LD block, association of all possible combinations of genotyped markers within the region is studied. The combined patient and control groups can be randomly divided into two sets, equal in size to the original group of patients and controls. The marker and haplotype analysis is then repeated and the most significant p-value registered is determined. This randomization scheme can be repeated, for example, over 100 times to construct an empirical distribution of p-values. In a preferred embodiment, a p-value of <0.05 is indicative of an significant marker and/or haplotype association.

Haplotype Analysis

One general approach to haplotype analysis involves using likelihood-based inference applied to NEsted MOdels (Gretarsdottir S., et al., *Nat. Genet.* 35:131-38 (2003)). The method is implemented in the program NEMO, which allows for many polymorphic markers, SNPs and microsatellites. The method and software are specifically designed for case-control studies where the purpose is to identify haplotype groups that confer different risks. It is also a tool for studying LD structures. In NEMO, maximum likelihood estimates, likelihood ratios and p-values are calculated directly, with the aid of the EM algorithm, for the observed data treating it as a missing-data problem.

Even though likelihood ratio tests based on likelihoods computed directly for the observed data, which have captured the information loss due to uncertainty in phase and missing genotypes, can be relied on to give valid p-values, it would still be of interest to know how much information had been lost due to the information being incomplete. The information measure for haplotype analysis is described in Nicolae and Kong (Technical Report 537, Department of Statistics, University of Statistics, University of Chicago; *Biometrics,* 60(2):368-75 (2004)) as a natural extension of information measures defined for linkage analysis, and is implemented in NEMO.

For single marker association to a disease, the Fisher exact test can be used to calculate two-sided p-values for each individual allele. Usually, all p-values are presented unadjusted for multiple comparisons unless specifically indicated. The presented frequencies (for microsatellites, SNPs and haplotypes) are allelic frequencies as opposed to carrier frequencies. To minimize any bias due the relatedness of the patients who were recruited as families to the study, first and second-degree relatives can be eliminated from the patient list. Furthermore, the test can be repeated for association correcting for any remaining relatedness among the patients, by extending a variance adjustment procedure previously described (Risch, N. & Teng, J. (*Genome Res.,* 8:1273-1288 (1998)), for sibships so that it can be applied to general familial relationships, and present both adjusted and unadjusted p-values for comparison. The method of genomic controls (Devlin, B. & Roeder, K. *Biometrics* 55:997 (1999)) can also be used to adjust for the relatedness of the individuals and possible stratification. The differences are in general very small as expected. To assess the significance of single-marker association corrected for multiple testing we can carry out a randomization test using the same genotype data. Cohorts of patients and controls can be randomized and the association analysis redone multiple times (e.g., up to 500,000 times) and the p-value is the fraction of replications that produced a p-value for some marker allele that is lower than or equal to the p-value we observed using the original patient and control cohorts.

For both single-marker and haplotype analyses, relative risk (RR) and the population attributable risk (PAR) can be calculated assuming a multiplicative model (haplotype relative risk model) (Terwilliger, J. D. & Ott, J., *Hum. Hered.* 42:337-46 (1992) and Falk, C. T. & Rubinstein, P, *Ann. Hum. Genet.* 51 (Pt 3):227-33 (1987)), i.e., that the risks of the two alleles/haplotypes a person carries multiply. For example, if RR is the risk of A relative to a, then the risk of a person homozygote AA will be RR times that of a heterozygote Aa and $RR^2$ times that of a homozygote aa. The multiplicative model has a nice property that simplifies analysis and computations—haplotypes are independent, i.e., in Hardy-Weinberg equilibrium, within the affected population as well as within the control population. As a consequence, haplotype counts of the affecteds and controls each have multinomial distributions, but with different haplotype frequencies under the alternative hypothesis. Specifically, for two haplotypes, $h_i$ and $h_j$, $risk(h_i)/risk(h_j)=(f_i/p_i)/(f_j/p_j)$, where f and p denote, respectively, frequencies in the affected population and in the control population. While there is some power loss if the true model is not multiplicative, the loss tends to be mild except for extreme cases. Most importantly, p-values are always valid since they are computed with respect to null hypothesis.

An association signal detected in one association study may be replicated in a second cohort, ideally from a different population (e.g., different region of same country, or a different country) of the same or different ethnicity. The advantage of replication studies is that the number of tests performed in the replication study, and hence the less stringent the statistical measure that is applied. For example, for a genome-wide search for susceptibility variants for a particular disease or trait using 300,000 SNPs, a correction for the 300,000 tests performed (one for each SNP) can be performed. Since many SNPs on the arrays typically used are correlated (i.e., in LD), they are not independent. Thus, the correction is conservative. Nevertheless, applying this correction factor requires an observed P-value of less than $0.05/300,000=1.7\times10^{-7}$ for the signal to be considered significant applying this conservative test on results from a single study cohort. Obviously, signals found in a genome-wide association study with P-values less than this conservative threshold are a measure of a true genetic effect, and replication in additional cohorts is not necessarily from a statistical point of view. However, since the correction factor depends on the number of statistical tests performed, if one signal (one SNP) from an initial study is replicated in a second case-control cohort, the appropriate statistical test for significance is that for a single statistical test, i.e., P-value less than 0.05. Replication studies in one or even several additional case-control cohorts have the added advantage of providing assessment of the association signal in additional populations, thus simultaneously confirming the initial finding and providing an assessment of the overall significance of the genetic variant(s) being tested in human populations in general.

The results from several case-control cohorts can also be combined to provide an overall assessment of the underlying effect. The methodology commonly used to combine results from multiple genetic association studies is the Mantel-Haenszel model (Mantel and Haenszel, *J Natl Cancer Inst* 22:719-48 (1959)). The model is designed to deal with the situation where association results from different populations, with each possibly having a different population frequency of the genetic variant, are combined. The model combines the results assuming that the effect of the variant on the risk of the disease, a measured by the OR or RR, is the same in all populations, while the frequency of the variant may differ between the populations. Combining the results from several populations has the added advantage that the overall power to detect a real underlying association signal is increased, due to the increased statistical power provided by the combined cohorts. Furthermore, any deficiencies in individual studies, for example due to unequal matching of cases and controls or population stratification will tend to balance out when results from multiple cohorts are combined, again providing a better estimate of the true underlying genetic effect.

Susceptibility

In certain methods described herein, an individual who is at an increased susceptibility (i.e., increased risk) for any specific disease or trait under study (e.g., eosinophilia, asthma, myocardial infarction, hypertension), is an individual in whom at least one specific allele at one or more polymorphic marker or haplotype conferring (or is shown to correlate with) increased susceptibility for the disease or trait is identified (i.e., at-risk marker alleles or haplotypes). In one aspect, the at-risk marker or haplotype is one that confers a significant or substantial increased risk (or susceptibility) of the disease or trait. In one embodiment, susceptibility associated with a marker or haplotype is measured by a relative risk (RR). In another embodiment, susceptibility associated with a marker or haplotype is measured by an odds ratio (OR). In a further embodiment, the susceptibility is measured by a percentage. In one embodiment, an increased risk is measured as a risk (relative risk and/or odds ratio) of at least about 1.00, including but not limited to: at least about 1.05, at least about 1.10, at least about 1.11, at least about 1.12, at least about 1.13, at least about 1.14, at least about 1.15, at least about 1.16, at least about 1.17, at least about 1.18, at least about 1.19, or at least about 1.20 (e.g., at least about 1.3, at least about 1.4, at least about 1.5, at least about 1.6, at least about 1.7, at least about 1.8, at least about 1.9, at least about 2.0, at least about 2.5, at least about 3.0, at least about 4.0, and at least about 5.0). In a particular embodiment, a risk (relative risk and/or odds ratio) of at least 1.1 is deemed substantial. However, other cutoffs are also contemplated, e.g. at least 1.05, 1.15, 1.25, 1.35, and so on, and such cutoffs are also within scope of the invention. In other embodiments, a substantial increase in risk is at least about 5% or 10% or 15% or 20%, including but not limited to about 25%, 30%, 35%, 40%, 45%, 50%, 55%, 60%, 65%, 70%, 75%, 80%, 85%, 90%, 95%, 100%, 150%, 200%, 300%, and 500%. In one particular embodiment, a significant increase in risk is at least 10%. Other cutoffs or ranges as deemed suitable by the person skilled in the art to characterize the invention are however also contemplated, and those are also within scope of the invention.

An at-risk polymorphic marker or haplotype of the invention is one where at least one allele of at least one marker or haplotype is more frequently present in an individual at risk for the disease or trait (affected), or diagnosed with the disease or trait, compared to the frequency of its presence in a comparison group (control), such that the presence of the marker or haplotype is indicative of susceptibility to the disease or trait. The control group may in one embodiment be a population sample, i.e. a random sample from the general population. In another embodiment, the control group is represented by a group of individuals who are disease-free. Such a disease-free control may in one embodiment be characterized by the absence of one or more specific disease-associated symptoms (e.g., symptoms associated with eosinophilia, asthma, myocardial infarction, hypertension). In another embodiment, the disease-free control group is characterized by the absence of one or more disease-specific risk factors. Such risk factors are in one embodiment at least one environmental risk factor. Representative environmental factors are natural products, minerals or other chemicals which are known to affect, or contemplated to affect, the risk of developing the specific disease or trait. Other environmental risk factors are risk factors related to lifestyle, including but not limited to food and drink habits, geographical location of main habitat, and occupational risk factors. In another embodiment, the risk factors are at least one genetic risk factor.

As an example of a simple test for correlation is a Fisher-exact test on a two by two table. Given a cohort of chromosomes, the two by two table is constructed out of the number of chromosomes that include both of the markers or haplotypes, one of the markers or haplotypes but not the other and neither of the markers or haplotypes.

In other embodiments of the invention, an individual who is at a decreased susceptibility (i.e., at a decreased risk) for a disease or trait is an individual in whom at least one specific allele at one or more polymorphic marker or haplotype conferring decreased susceptibility for the disease or trait is identified. The marker alleles and/or haplotypes conferring decreased risk are also said to be protective. In one aspect, the protective marker or haplotype is one that confers a substantial decreased risk (or susceptibility) of the disease or trait. In one embodiment, substantial decreased risk is measured as a relative risk of less than 0.9, including but not limited to less than 0.9, less than 0.8, less than 0.7, less than 0.6, less than 0.5, less than 0.4, less than 0.3, less than 0.2 and less than 0.1. In one particular embodiment, substantial decreased risk is less than 0.7. In another embodiment, substantial decreased risk is less than 0.5. In yet another embodiment, substantial decreased risk is less than 0.3. In another embodiment, the decrease in risk (or susceptibility) is at least 20%, including but not limited to at least 25%, at least 30%, at least 35%, at least 40%, at least 45%, at least 50%, at least 55%, at least 60%, at least 65%, at least 70%, at least 75%, at least 80%, at least 85%, at least 90%, at least 95% and at least 98%. In one particular embodiment, a substantial decrease in risk is at least about 30%. In another embodiment, a significant decrease in risk at least about 50%. In another embodiment, the decrease in risk is at least about 70%. Other cutoffs or ranges as deemed suitable by the person skilled in the art to characterize the invention are however also contemplated, and those are also within scope of the invention.

The person skilled in the art will appreciate that for markers with exactly two alleles present in the population being studied, and wherein one allele is found in increased frequency in a group of individuals with a trait or disease in the population, compared with controls, the other allele of the marker will be found in decreased frequency in the group of individuals with the trait or disease, compared with controls. In such a case, one allele of the marker (the one found in increased frequency in individuals with the trait or disease) will be the at-risk allele, while the other allele will be a protective allele.

A genetic variant associated with a disease or a trait (e.g. eosinophilia, asthma, myocardial infarction, hypertension) can be used alone to predict the risk of the disease for a given genotype. For a biallelic marker, such as a SNP, there are 3 possible genotypes: homozygote for the at risk variant, heterozygote, and non-carrier of the at risk variant. Risk associated with variants at multiple loci can be used to estimate overall risk. For multiple SNP variants, there are k possible genotypes $k=3n \times 2p$; where n is the number autosomal loci and p the number of gonosomal (sex chromosomal) loci. Overall risk assessment calculations usually assume that the relative risks of different genetic variants multiply, i.e. the overall risk (e.g., RR or OR) associated with a particular genotype combination is the product of the risk values for the genotype at each locus. If the risk presented is the relative risk for a person, or a specific genotype for a person, compared to a reference population with matched gender and ethnicity, then the combined risk—is the product of the locus specific risk values—and which also corresponds to an overall risk estimate compared with the population. If the risk for a person is based on a comparison to non-carriers of the at risk allele, then the combined risk corresponds to an estimate that compares the person with a given combination of genotypes at all loci to a group of individuals who do not carry risk variants at any of those loci. The group of non-carriers of any at risk variant has the lowest estimated risk and has a combined risk, compared with itself (i.e., non-carriers) of 1.0, but has an overall risk, compare with the population, of less than 1.0. It should be noted that the group of non-carriers can potentially be very small, especially for large number of loci, and in that case, its relevance is correspondingly small.

The multiplicative model is a parsimonious model that usually fits the data of complex traits reasonably well. Deviations from multiplicity have been rarely described in the context of common variants for common diseases, and if reported are usually only suggestive since very large sample sizes are usually required to be able to demonstrate statistical interactions between loci.

By way of an example, let us consider a total of eight variants that have been described to associate with prostate cancer (Gudmundsson et al., *Nat Genet.* 39:631-7 (2007), Gudmundsson et al., *Nat Genet.* 39:977-83 (2007); Yeager et al, *Nat Genet.* 39:645-49 (2007), Amundadottir et al., *Nat Genet.* 38:652-8 (2006); Haiman et al., *Nat Genet.* 39:638-44 (2007)). Seven of these loci are on autosomes, and the remaining locus is on chromosome X. The total number of theoretical genotypic combinations is then $3^7 \times 2^1 = 4374$. Some of those genotypic classes are very rare, but are still possible, and should be considered for overall risk assessment. It is likely that the multiplicative model applied in the case of multiple genetic variant will also be valid in conjugation with non-genetic risk variants assuming that the genetic variant does not clearly correlate with the "environmental" factor. In other words, genetic and non-genetic at-risk variants can be assessed under the multiplicative model to estimate combined risk, assuming that the non-genetic and genetic risk factors do not interact.

Using the same quantitative approach, the combined or overall risk associated with a plurality of variants associated with eosinophilia, asthma, myocardial infarction, and/or hypertension may be assessed.

Database

Determining susceptibility can alternatively or additionally comprise comparing the nucleic acid sequence data to a database containing correlation data between polymorphic markers of at least one of the genes and susceptibility to eosinophilia, a condition causative of eosinophilia (e.g., asthma, myocardial infection), or hypertension. The database can be part of a computer-readable medium described herein.

In a specific aspect of the invention, the database comprises at least one measure of susceptibility to eosinophilia, a condition causative of eosinophilia (e.g., asthma, myocardial infection), or hypertension, for the polymorphic markers.

In another specific aspect of the invention, the database comprises a look-up table containing at least one measure of susceptibility to eosinophilia, a condition causative of eosinophilia (e.g., asthma, myocardial infection), or hypertension for the polymorphic markers.

Further Steps

The methods disclosed herein can comprise additional steps which may occur before, after, or simultaneously with one of the aforementioned steps of the method of the invention. In a specific embodiment of the invention, the method of determining a susceptibility to eosinophilia, a condition causative of eosinophilia (e.g., asthma, myocardial infarction), or hypertension, further comprises reporting the susceptibility to at least one entity selected from the group consisting of the individual, a guardian of the individual, a genetic service provider, a physician, a medical organization, and a medical insurer. The reporting may be accomplished by any of several means. For example, the reporting can comprise sending a written report on physical media or electronically or providing an oral report to at least one entity of the group, which written or oral report comprises the susceptibility. Alternatively, the reporting can comprise providing the at least one entity of the group with a login and password, which provides access to a report comprising the susceptibility posted on a password-protected website.

Study Population

In a general sense, the methods and kits of the invention can be utilized from samples containing genomic DNA from any source, i.e. any individual. In specific embodiments, the individual is a human individual. The individual can be an adult, child, or fetus. The invention also provides for assessing markers and/or haplotypes in individuals who are members of a target population. Such a target population is in one embodiment a population or group of individuals at risk of developing eosinophilia, a condition causative of eosinophilia (e.g., asthma, myocardial infarction), or hypertension, based on other genetic factors, biomarkers, biophysical parameters, history of eosinophilia, asthma, myocardial infarction, hypertension, or related diseases, previous diagnosis of eosinophilia, asthma, myocardial infarction, hypertension, family history of eosinophilia, asthma, myocardial infarction, hypertension or general health and/or lifestyle parameters.

The invention provides for embodiments that include individuals from specific age subgroups, of a specific gender, or of a specific ethnic background.

The Icelandic population is a Caucasian population of Northern European ancestry. A large number of studies reporting results of genetic linkage and association in the Icelandic population have been published in the last few years. Many of those studies show replication of variants, originally identified in the Icelandic population as being associating with a particular disease, in other populations (Styrkarsdottir et al., *N Engl J Med* 358:2355-65 (2008); Thorgeirsson et al., *Nature* 452:638-42 (2008); Gudmundsson et al., *Nat. Genet.* 40:281-3 (2008); Stacey et al., *Nat. Genet.* 39:865-69 (2007); Helgadottir et al., *Science* 316:1491-93 (2007); Steinthorsdottir et al., *Nat. Genet.* 39:770-75 (2007); Gudmundsson et al., *Nat. Genet.* 39:631-37 (2007); Frayling, *Nature Reviews Genet.* 8:657-662 (2007); Amundadottir et al., *Nat. Genet.* 38:652-58 (2006); Grant et al., *Nat. Genet.* 38:320-23 (2006)). Thus, genetic findings in the Icelandic population have in general been replicated in other populations, including populations from Africa and Asia. Moreover, the association of the variants described herein to be associated with increased risk of eosinophilia, asthma, myocardial infarction and/or hypertension has been replicated in several populations, including Caucasians from Europe and North America (e.g., Icelandic, Italian, German, British, Danish, and Dutch), Caucasian Australians, New Zealanders, Hong Kong Chinese, and in Koreans.

The markers of the present invention found to be associated with eosinophilia, asthma, myocardial infarction, and/or hypertension are therefore believed to show similar association in all human populations. Particular embodiments comprising individual human populations are thus also contemplated and within the scope of the invention. Such embodiments relate to human individuals that are from one or more human population including, but not limited to, Caucasian populations, European populations, American populations, Eurasian populations, Asian populations, Central/South Asian populations, East Asian populations, Middle Eastern populations, African populations, Hispanic populations, and Oceanian populations. European populations include, but are not limited to, Swedish, Norwegian, Finnish, Russian, Danish, Icelandic, Irish, Kelt, English, Scottish, Dutch, Belgian, French, German, Spanish, Portuguese, Italian, Polish, Bulgarian, Slavic, Serbian, Bosnian, Chech, Greek and Turkish populations. The invention furthermore in other embodiments can be practiced in specific human populations that include Bantu, Mandenk, Yoruba, San, Mbuti Pygmy, Orcadian, Adygel, Russian, Sardinian, Tuscan, Mozabite, Bedouin, Druze, Palestinian, Balochi, Brahui, Makrani, Sindhi, Pathan, Burusho, Hazara, Uygur, Kalash, Han, Dai, Daur, Hezhen, Lahu, Miao, Orogen, She, Tujia, Tu, Xibo, Yi, Mongolan, Naxi, Cambodian, Japanese, Yakut, Melanesian, Papuan, Karitianan, Surui, Colombian, Maya, Pima, Korean, Hong Kong Chinese, New Zealander, and Caucasian Austrailian.

In certain embodiments, the invention relates to populations that include black African ancestry such as populations comprising persons of African descent or lineage. Black African ancestry may be determined by self reporting as African-Americans, Afro-Americans, Black Americans, being a member of the black race or being a member of the negro race. For example, African Americans or Black Americans are those persons living in North America and having origins in any of the black racial groups of Africa. In another example, self-reported persons of black African ancestry may have at least one parent of black African ancestry or at least one grandparent of black African ancestry.

The racial contribution in individual subjects may also be determined by genetic analysis. Genetic analysis of ancestry may be carried out using unlinked microsatellite markers such as those set out in Smith et al. (*Am J Hum Genet.* 74, 1001-13 (2004)).

In certain embodiments, the invention relates to markers and/or haplotypes identified in specific populations, as described in the above. The person skilled in the art will appreciate that measures of linkage disequilibrium (LD) may give different results when applied to different populations. This is due to different population history of different human populations as well as differential selective pressures that may have led to differences in LD in specific genomic regions. It is also well known to the person skilled in the art that certain markers, e.g. SNP markers, have different population frequency in different populations, or are polymorphic in one population but not in another. The person skilled in the art will however apply the methods available and as taught herein to practice the invention in any given human population. This may include assessment of polymorphic markers in the LD region of the present invention, so as to identify those markers that give strongest association within the specific population. Thus, the at-risk variants of the invention may reside on different haplotype background and in different frequencies in various human populations. However, utilizing methods taught herein and the markers of the invention, the invention can be practiced in any given human population.

Screening Methods

The invention also provides a method of screening a candidate marker for assessing susceptibility to a condition causative of or correlative/associated with eosinophilia. The method comprises analyzing the frequency of at least one allele of a polymorphic marker in a population of human individuals diagnosed with the condition, wherein a significant difference in frequency of the at least one allele in the population of human individuals diagnosed with the condition as compared to the frequency of the at least one allele in a control population of human individuals is indicative of the allele as a marker of the condition.

In a specific embodiment of the invention, the at least one allele of a polymorphic marker is selected from the group consisting of: the C allele of rs1050152, the A allele of rs11066320, the G allele of rs11679137, the C allele of rs11778166, the A allele of rs11950562, the G allele of rs12411706, the G allele of rs9954643, the A allele of rs12619285, the T allele of rs1265566, the T allele of rs12998521, the A allele of rs1370631, the T allele of rs1412426, the A allele of rs1420101, the A allele of rs1467412, the A allele of rs1559930, the G allele of rs1805419, the G allele of rs184941, the T allele of rs2079103, the C allele of rs2164850, the A allele of rs2165427, the C allele of rs2188962, the C allele of rs2244012, the T allele of rs2269426, the C allele of rs231228, the C allele of rs2335050, the G allele of rs233716, the C allele of rs233722, the G allele of rs2416257, the C allele of rs2426358, the C allele of rs2532072, the T allele of rs2663041, the A allele of rs272893, the G allele of rs273148, the A allele of rs2897443, the T allele of rs3184504, the A allele of rs3939286, the A allele of rs4143832, the G allele of rs4629469, the G allele of rs4773225, the A allele of rs4851400, the T allele of rs4851411, the C allele of rs4857855, the T allele of rs6439132, the A allele of rs6503609, the G allele of rs653178, the T allele of rs6730424, the C allele of rs6871536, the G allele of rs7150454, the G allele of rs7223150, the A allele of rs7315519, the A allele of rs748065, the A allele of rs7635061, the C allele of rs927220, the T allele of rs9494145, and the A allele of rs992969.

In another specific aspect, the at least one allele is selected from the group consisting of: the A allele of rs1420101, the A allele of rs12619285, the C allele of rs4857855, the A allele of rs7635061, the G allele of rs2416257, the G allele of rs184941, the A allele of rs4143832, the T allele of rs2079103, the T allele of rs2269426, the T allele of rs9494145, the A allele of rs748065, the T allele of rs1412426, the A allele of rs3939286, the T allele of rs3184504, and the G allele of rs653178.

In yet another specific aspect of the invention, the at least one allele is selected from the group consisting of: the A allele of rs1420101, the A allele of rs12619285, the C allele of rs4857855, the G allele of rs2416257, the A allele of rs4143832, the T allele of rs2269426, the T allele of rs9494145, the A allele of rs748065, the A allele of rs3939286, and the T allele of rs3184504.

With regard to the screening method of the invention, the condition causative of or correlated/associated with eosinophilia can be any of those described herein. For example, the condition can be one of eczema, atopic dermatitis, rhinitis, a parasitic infection, a drug reaction, Loeffler's syndrome, vasculitis, Churg-Strauss syndrome, tumors, cirrhosis, an antibody deficiency, dermatitis, herpetiformis, leukemia, an inflammatory disease, allergic rhinoconjuntivitis, eosinophil esophagitis, eosinophili fascitis, and an autoimmune disease.

Suitable methods of analyzing the frequency of alleles in a human population are known in the art and include, for example, calculating the allele frequency from genotype frequency and consulting the allele frequency database (ALFRED) (see, for example, Cheung et al., *Nucl Acids Res* 28: 361-363 (2000)).

Genotyping Methods

The invention further provides methods of genotyping a sample, e.g., a nucleic acid sample, obtained from a human individual. In one embodiment, the human individual is at risk for, or diagnosed with, eosinophilia. The method comprises determining the identity of at least one allele of at least one polymorphic marker in the sample, wherein the marker is selected from the group consisting of: rs1050152, rs11066320, rs11679137, rs11778166, rs11950562, rs12411706, rs9954643, rs12619285, rs1265566, rs12998521, rs1370631, rs1412426, rs1420101, rs1467412, rs1559930, rs1805419, rs184941, rs2079103, rs2164850, rs2165427, rs2188962, rs2244012, rs2269426, rs231228, rs2335050, rs233716, rs233722, rs2416257, rs2426358, rs2532072, rs2663041, rs272893, rs273148, rs2897443, rs3184504, rs3939286, rs4143832, rs4629469, rs4773225, rs4851400, rs4851411, rs4857855, rs6439132, rs6503609, rs653178, rs6730424, rs6871536, rs7150454, rs7223150, rs7315519, rs748065, rs7635061, rs927220, rs9494145, and rs992969, and markers in linkage disequilibrium therewith. In this embodiment of the inventive genotyping methods, the identity of the at least one allele of the at least one polymorphic marker is indicative of a susceptibility to eosinophilia.

In another embodiment, the human individual is at risk for, or diagnosed with, asthma, and the method comprises determining the identity of at least one allele of at least one polymorphic marker in the sample, wherein the marker is selected from the group consisting of: rs1420101, rs3939286, rs2416257, and rs9494145, and markers in linkage disequilibrium therewith. In this embodiment of the inventive genotyping methods, the identity of the at least one allele of the at least one polymorphic marker is indicative of a susceptibility (or contribution factor for) to asthma.

In yet another embodiment of the invention, the human individual is at risk for, or diagnosed with, myocardial infarction, and the method comprises determining the identity of at least one allele of at least one polymorphic marker in the sample, wherein the marker is selected from the group consisting of: rs3184504 and rs653178, and markers in linkage disequilibrium therewith. In this embodiment of the inventive genotyping methods, the identity of the at least one allele of the at least one polymorphic marker is indicative of a susceptibility (or contribution factor for) to myocardial infarction.

In yet another embodiment of the invention, the human individual is at risk for, or diagnosed with, hypertension, and the method comprises determining the identity of at least one allele of at least one polymorphic marker in the sample, wherein the marker is selected from the group consisting of: rs3184504, and markers in linkage disequilibrium therewith. In this embodiment of the inventive genotyping methods, the identity of the at least one allele of the at least one polymorphic marker is indicative of a susceptibility (or contribution factor for) to hypertension.

Suitable methods of genotyping are known in the art and include, for example, any of the genotyping methods described herein.

Utility of Genetic Testing

The variants described herein in general do not, by themselves, provide an absolute identification of individuals who will develop a particular disease. The variants described herein do however indicate increased and/or decreased likelihood that individuals carrying the at-risk or protective variants of the invention will develop symptoms associated with eosinophilia, asthma, myocardial infarction, and/or hypertension. This information is however extremely valuable in itself, as outlined in more detail in the below, as it can be used to, for example, initiate preventive measures at an early stage, perform regular physical and/or mental exams to monitor the progress and/or appearance of symptoms, or to schedule exams at a regular interval to identify the condition in question, so as to be able to apply treatment at an early stage.

The knowledge about a genetic variant that confers a risk of developing eosinophilia, asthma, myocardial infarction, and/or hypertension offers the opportunity to apply a genetic test to distinguish between individuals with increased risk (attributable to the genetic variant) of developing eosinophilia, asthma, myocardial infarction, and/or hypertension (i.e. carriers of the at-risk variant) and those with decreased risk of developing eosinophilia, asthma, myocardial infarction, and/or hypertension (i.e. carriers of the protective variant). The core values of genetic testing, for individuals belonging to both of the above mentioned groups, are the possibilities of being able to diagnose eosinophilia, asthma, myocardial infarction, and/or hypertension, or a predisposition to eosinophilia, asthma, myocardial infarction, and/or hypertension, at an early stage and provide information to the clinician about prognosis/aggressiveness of eosinophilia, asthma, myocardial infarction, and/or hypertension, in order to be able to apply the most appropriate treatment.

Individuals with a family history of eosinophilia, asthma, myocardial infarction, and/or hypertension, and carriers of at-risk variants may benefit from genetic testing since the knowledge of the presence of a genetic risk factor, or evidence for increased risk of being a carrier of one or more risk factors, may provide increased incentive for implementing a healthier lifestyle, by avoiding or minimizing known environmental risk factors for eosinophilia, asthma, myocardial infarction, and/or hypertension. Genetic testing of eosinophilia, asthma, myocardial infarction, and/or hypertension patients may furthermore give valuable information about the primary cause of eosinophilia, asthma, myocardial infarction, and/or hypertension and can aid the clinician in selecting the best treatment options and medication for each individual. Further, individuals who are carriers of the at-risk variants of the invention are likely to benefit from regular monitoring from the clinician, so as to minimize the risk of developing symptoms with, or being diagnosed with, eosinophilia, asthma, myocardial infarction, and/or hypertension.

The invention furthermore relates to risk assessment for eosinophilia, asthma, myocardial infarction, and/or hypertension, including diagnosing whether an individual is at risk for developing eosinophilia, asthma, myocardial infarction, and/or hypertension. The polymorphic markers of the invention can be used alone or in combination, as well as in combination with other factors, including other genetic risk factors or biomarkers, for risk assessment of an individual for eosinophilia, asthma, myocardial infarction, and/or hypertension.

Yet another utility lies on the use of genetic markers to determine whether to apply particular treatment modalities. Thus, based on the carrier status of particular markers and haplotypes described herein to be associated with risk of eosinophilia, asthma, myocardial infarction, and/or hypertension, a particular treatment is administered. This can for example be done by first determining whether an individual is carrying at least one particular risk allele of one or more markers, or by determining the carrier status of the individual with respect to at least one particular haplotype. Based on the result of the genetic analysis, the particular treatment modality is administered.

Methods known in the art can be used for such assessment, including multivariate analyses or logistic regression.

Prognostic Methods

In addition to the utilities described above, the polymorphic markers of the invention are useful in determining a prognosis of a human individual experiencing symptoms associated with, or an individual diagnosed with eosinophilia, asthma, myocardial infarction, and/or hypertension. Accordingly, the invention provides a method of predicting prognosis of an individual experiencing symptoms associated with, or an individual diagnosed with, eosinophilia. The method comprises obtaining sequence data about a human individual identifying at least one allele of at least one polymorphic marker associated with a gene selected from the group consisting of ATP9A, ATXN2, BAX, CUX2, IL1RL1, IL33, LBH, LOC441108, PTPN11, RAD50, RAD51L1, SH2B3, SLC22A4, SNX6, TBC1D8, TNKS2, and TNXB, wherein different alleles of the at least one polymorphic marker are associated with different susceptibilities to eosinophilia in humans, and predicting prognosis of the individual from the sequence data. In one embodiment, the at least one polymorphic marker selected from the group consisting of: rs1050152, rs11066320, rs11679137, rs11778166, rs11950562, rs12411706, rs9954643, rs12619285, rs1265566, rs12998521, rs1370631, rs1412426, rs1420101, rs1467412, rs1559930, rs1805419, rs184941, rs2079103, rs2164850, rs2165427, rs2188962, rs2244012, rs2269426, rs231228, rs2335050, rs233716, rs233722, rs2416257, rs2426358, rs2532072, rs2663041, rs272893, rs273148, rs2897443, rs3184504, rs3939286, rs4143832, rs4629469, rs4773225, rs4851400, rs4851411, rs4857855, rs6439132, rs6503609, rs653178, rs6730424, rs6871536, rs7150454, rs7223150, rs7315519, rs748065, rs7635061, rs927220, rs9494145, and rs992969, and markers in linkage disequilibrium therewith.

The invention also provides a method of predicting prognosis of an individual experiencing symptoms associated with, or an individual diagnosed with, asthma. The method comprises obtaining sequence data about a human individual identifying at least one allele of at least one polymorphic marker associated with a gene selected from the group consisting of IL1RL1, IL33, and WDR36, wherein different alleles of the at least one polymorphic marker are associated with different susceptibilities to asthma in humans, and predicting prognosis of the individual from the sequence data. In one embodiment, the at least one polymorphic marker is selected from the group consisting of rs1420101, rs3939286, rs2416257, and rs9494145, and markers in linkage disequilibrium therewith.

The invention further provides a method of predicting prognosis of an individual experiencing symptoms associated with, or an individual diagnosed with, myocardial infarction. The method comprises obtaining sequence data about a human individual identifying at least one allele of at least one polymorphic marker associated with a gene selected from the group consisting of SH2B3 and ATXN2, wherein different alleles of the at least one polymorphic marker are associated with different susceptibilities to myocardial infarction in humans, and predicting prognosis of the individual from the sequence data. In one embodiment, the at least one marker is selected from the group consisting of: rs3184504 and rs653178, and markers in linkage disequilibrium therewith.

The invention further provides a method of predicting prognosis of an individual experiencing symptoms associated with, or an individual diagnosed with, hypertension. The method comprises obtaining sequence data about a human individual identifying at least one allele of at least one polymorphic marker associated with a gene selected from the group consisting of SH2B3, wherein different alleles of the at least one polymorphic marker are associated with different susceptibilities to hypertension in humans, and predicting prognosis of the individual from the sequence data. In one embodiment, the at least one marker is selected from the group consisting of: rs3184504, and markers in linkage disequilibrium therewith.

The prognosis predicted by the methods of the invention can be any type of prognosis relating to the progression of the eosinophilia, asthma, myocardial infarction, and/or hypertension, and/or relating to the chance of recovering from the condition. The prognosis can, for instance, relate to the severity of the eosinophilia, asthma, myocardial infarction, and/or hypertension, when a myocardial infarction or asthma attack might take place, or how the condition will respond to therapeutic treatment.

With regard to the prognostic methods described herein, the sequence data can be nucleic acid sequence data or amino acid sequence data. Suitable methods of obtaining each are known in the art, some of which are described herein.

Methods for Predicting Response to Therapeutic Agents

As is known in the art, individuals can have differential responses to a particular therapy (e.g., a therapeutic agent or therapeutic method). Pharmacogenomics addresses the issue of how genetic variations (e.g., the variants (markers and/or haplotypes) of the invention) affect drug response, due to altered drug disposition and/or abnormal or altered action of the drug. Thus, the basis of the differential response may be genetically determined in part. Clinical outcomes due to genetic variations affecting drug response may result in toxicity of the drug in certain individuals (e.g., carriers or non-carriers of the genetic variants of the invention), or therapeutic failure of the drug. Therefore, the variants of the invention may determine the manner in which a therapeutic agent and/or method acts on the body, or the way in which the body metabolizes the therapeutic agent.

Accordingly, in one embodiment, the presence of a particular allele at a polymorphic site or haplotype is indicative of a different response, e.g. a different response rate, to a particular treatment modality. This means that a patient diagnosed with eosinophilia, asthma, myocardial infarction, and/or hypertension and carrying a certain allele at a polymorphic site or haplotype of the invention (e.g., the at-risk markers of the invention) would respond better to, or worse to, a specific therapeutic, drug and/or other therapy used to treat the disease. Therefore, the presence or absence of the marker allele or haplotype could aid in deciding what treatment should be used for the patient. For example, for a newly diagnosed patient, the presence of a marker or haplotype of the invention may be assessed (e.g., through testing DNA derived from a blood sample, as described herein). If the patient is positive for a marker allele or haplotype at (that is, at least one specific allele of the marker, or haplotype, is present), then the physician recommends one particular therapy, while if the patient is negative for the at least one allele of a marker, or a haplotype, then a different course of therapy may be recommended (which may include recommending that no immediate therapy, other than serial monitoring for progression of the disease, be performed). Thus, the patient's carrier status could be used to help determine whether a particular treatment modality should be administered. The value lies within the possibilities of being able to diagnose the disease at an early stage, to select the most appropriate treatment, and provide information to the clinician about prognosis/aggressiveness of the disease in order to be able to apply the most appropriate treatment.

Another aspect of the invention relates to methods of selecting individuals suitable for a particular treatment modality, based on the their likelihood of developing particular complications or side effects of the particular treatment. It is well known that most therapeutic agents can lead to certain unwanted complications or side effects. Likewise, certain therapeutic procedures or operations may have complications associated with them. Complications or side effects of these particular treatments or associated with specific therapeutic agents can, just as diseases do, have a genetic component. It is therefore contemplated that selection of the appropriate treatment or therapeutic agent can in part be performed by determining the genotype of an individual, and using the genotype status of the individual to decide on a suitable therapeutic procedure or on a suitable therapeutic agent to treat the particular disease. It is therefore contemplated that the polymorphic markers of the invention can be used in this manner. In particular, the polymorphic markers of the invention can be used to determine whether administration of a particular therapeutic agent or treatment modality or method is suitable for the individual, based on estimating the likelihood that the individual will develop symptoms associated with eosinophilia, asthma, myocardial infarction, and/or hypertension as a consequence of being administered the particular therapeutic agent or treatment modality or method. Indiscriminate use of a such therapeutic agents or treatment modalities may lead to unnecessary and needless adverse complications.

In view of the foregoing, the invention provides a method of assessing an individual for probability of response to a therapeutic agent for preventing, treating, and/or ameliorating symptoms associated with eosinophilia. In one embodiment, the method comprises: determining the identity of at least one allele of at least one polymorphic marker in a sample, e.g., a nucleic acid sample, obtained from the individual, wherein the at least one polymorphic marker is selected from polymorphic markers associated with a gene selected from the group consisting of ATP9A, ATXN2, BAX, CUX2, IL1RL1, IL33, LBH, LOC441108, PTPN11, RAD50, RAD51L1, SH2B3, SLC22A4, SNX6, TBC1D8, TNKS2, TNXB, BRAP, ACAD10, ALDH2, MAPKAPK5, and ERP29, wherein the identity of the at least one allele of the at least one marker is indicative of a probability of a positive response to the therapeutic agent.

In another embodiment, the method comprises: determining the identity of at least one allele of at least one polymorphic marker in a sample, e.g., a nucleic acid sample, obtained from the individual, wherein the at least one polymorphic marker is selected from the group consisting of: rs1370631, rs4851400, rs4851411, rs12998521, rs1559930, rs6439132, rs2335050, rs11950562, rs272893, rs1050152, rs2188962, rs2244012, rs2897443, rs6871536, rs992969, rs1265566, rs7315519, rs927220, rs1467412, rs12411706, rs233722, rs233716, rs1805419, rs9954643, rs273148, rs3939286, rs1420101, rs11066320, rs4857855, rs9494145, rs2416257, rs2079103, rs2165427, rs3184504, rs2663041, rs1412426, rs11778166, rs4143832, rs653178, rs6730424, rs4629469, rs748065, rs11679137, rs2164850, rs12619285, rs2269426, rs7635061, rs184941, rs2532072, rs6503609, rs4773225, rs2426358, rs231228, rs7223150, and rs7150454, and markers in linkage disequilibrium therewith, wherein the identity of the at least one allele of the at least one marker is indicative of a probability of a positive response to the therapeutic agent.

The invention also provides a method of assessing an individual for probability of response to a therapeutic agent for preventing, treating, and/or ameliorating symptoms associated with asthma. In one embodiment, the method comprises: determining the identity of at least one allele of at least one polymorphic marker in a nucleic acid sample obtained from the individual, wherein the at least one polymorphic marker is selected from polymorphic markers associated with a gene selected from the group consisting of IL1RL1, IL33, and WDR36, wherein the identity of the at least one allele of the at least one marker is indicative of a probability of a positive response to the therapeutic agent.

In another embodiment, the method comprises: determining the identity of at least one allele of at least one polymorphic marker in a nucleic acid sample obtained from the individual, wherein the at least one polymorphic marker is selected from the group consisting of rs1420101, rs3939286, rs2416257, rs9494145, rs1420101, and markers in linkage disequilibrium therewith, wherein the identity of the at least one allele of the at least one marker is indicative of a probability of a positive response to the therapeutic agent.

The invention further provides a method of assessing an individual for probability of response to a therapeutic agent for preventing, treating, and/or ameliorating symptoms associated with myocardial infarction. In one embodiment, the method comprises: determining the identity of at least one allele of at least one polymorphic marker in a nucleic acid sample obtained from the individual, wherein the at least one polymorphic marker is selected from polymorphic markers associated with a gene selected from the group consisting of SH2B3 and ATXN2, wherein the identity of the at least one allele of the at least one marker is indicative of a probability of a positive response to the therapeutic agent.

In another embodiment, the method comprises: determining the identity of at least one allele of at least one polymorphic marker in a nucleic acid sample obtained from the individual, wherein the at least one polymorphic marker is selected from the group consisting of: rs3184504, rs653178, and markers in linkage disequilibrium therewith, wherein the identity of the at least one allele of the at least one marker is indicative of a probability of a positive response to the therapeutic agent.

The invention further provides a method of assessing an individual for probability of response to a therapeutic agent for preventing, treating, and/or ameliorating symptoms associated with hypertension. In one embodiment, the method comprises: determining the identity of at least one allele of at least one polymorphic marker in a nucleic acid sample obtained from the individual, wherein the at least one polymorphic marker is selected from polymorphic markers associated with a gene selected from the group consisting of SH2B3, wherein the identity of the at least one allele of the at least one marker is indicative of a probability of a positive response to the therapeutic agent.

In another embodiment, the method comprises: determining the identity of at least one allele of at least one polymorphic marker in a nucleic acid sample obtained from the individual, wherein the at least one polymorphic marker is selected from the group consisting of: rs3184504, and markers in linkage disequilibrium therewith, wherein the identity of the at least one allele of the at least one marker is indicative of a probability of a positive response to the therapeutic agent.

In a further aspect, the markers of the invention can be used to increase power and effectiveness of clinical trials. Thus, individuals who are carriers of at least one at-risk variant of the present invention, i.e. individuals who are carriers of at least one allele of at least one polymorphic marker conferring increased risk of developing eosinophilia, asthma, myocardial infarction, and/or hypertension may be more likely to respond to a particular treatment modality. In one embodiment, individuals who carry at-risk variants for gene(s) in a pathway and/or metabolic network for which a particular treatment (e.g., small molecule drug) is targeting, are more likely to be responders to the treatment. For some treatments, the genetic risk will correlate with less responsiveness to therapy. In another embodiment, individuals who carry at-risk variants for a gene, which expression and/or function is altered by the at-risk variant, are more likely to be responders (or non-responders) to a treatment modality targeting that gene, its expression or its gene product. This application can improve the safety of clinical trials, but can also enhance the chance that a clinical trial will demonstrate statistically significant efficacy, which may be limited to a certain sub-group of the population. Thus, one possible outcome of such a trial is that carriers of certain genetic variants, e.g., the markers and haplotypes of the invention, are statistically significantly likely to show positive response to the therapeutic agent, i.e. experience alleviation of symptoms associated with eosinophilia, asthma, myocardial infarction and/or hypertension when taking the therapeutic agent or drug as prescribed. Another possible outcome is that genetic carriers show less favorable response to the therapeutic agent, or show differential side-effects to the therapeutic agent compared to the non-carrier. An aspect of the invention is directed to screening for such pharmacogenetic correlations.

Diagnostic Methods

The polymorphic markers associated with increased susceptibility to eosinophilia, asthma, myocardial infarction, or hypertension are useful in diagnostic methods. While methods of diagnosing such conditions are known in the art, the detection of one or more alleles of the specific polymorphic markers advantageously reduces the occurrence of mis-diagnosis. In this regard, the invention further provides methods of diagnosing eosinophilia, asthma, myocardial infarction, or hypertension comprising obtaining sequence data, e.g., nucleic acid sequence data, identifying at least one allele of at least one polymorphic marker of a specified group, in conjunction with carrying out one or more steps, e.g., clinical diagnostic steps, such as any of those described herein.

With regard to the method of diagnosing eosinophilia, the group of polymorphic markers consists of rs1370631, rs4851400, rs4851411, rs12998521, rs1559930, rs6439132, rs2335050, rs11950562, rs272893, rs1050152, rs2188962, rs2244012, rs2897443, rs6871536, rs992969, rs1265566, rs7315519, rs927220, rs1467412, rs12411706, rs233722, rs233716, rs1805419, rs9954643, rs273148, rs3939286, rs1420101, rs11066320, rs4857855, rs9494145, rs2416257, rs2079103, rs2165427, rs3184504, rs2663041, rs1412426, rs11778166, rs4143832, rs653178, rs6730424, rs4629469, rs748065, rs11679137, rs2164850, rs12619285, rs2269426, rs7635061, rs184941, rs2532072, rs6503609, rs4773225, rs2426358, rs231228, rs7223150, and rs7150454, and markers in linkage disequilibrium therewith. In one embodiment, the identification of at least one allele of at least one of these polymorphic markers is carried out in conjunction with measuring the count of eosinophils in the blood of the human individual being diagnosed.

With regard to the method of diagnosing asthma, the group of polymorphic markers consists of rs1420101, rs3939286, rs2416257, rs9494145, rs1420101, and markers in linkage disequilibrium therewith. In one embodiment, the identification of at least one allele of at least one of these polymorphic markers is carried out in conjunction with one or a combination of (i) considering symptoms experienced by the human individual and/or the family history of the human individual, (ii) physically examining the upper respiratory tract, chest, and skin of the human individual, and (iii) conducting a breathing test on the human individual.

With regard to the method of diagnosing myocardial infarction, the group of polymorphic markers consists of rs3184504 and rs653178, and markers in linkage disequilibrium therewith. In a specific embodiment, the identification of at least one allele of at least one of these polymorphic markers is carried out in combination with one or a combination of (i) considering the history of an illness and the symptoms experienced by the human individual, (ii) physically examining the human individual, (iii) conducting one or a combination of an electrocardiogram, a coronary angiogram, chest radiograph, and echocardiogram on the human individual, (iv) testing blood of the human individual for cardiac markers, (v) detecting areas of reduced blood flow in conjunction with physiologic or pharmacologic stress, and (vi) determining the viability of tissue of the myocardium.

With regard to the method of diagnosing hypertension, the group of polymorphic markers consists of rs3184504, and markers in linkage disequilibrium therewith. In a specific embodiment, the identification of at least one allele of at least one of these polymorphic markers is carried out in combination with one or a combination of (i) measuring blood pressure level, (ii) conducting one or a combination of a blood test, a chest X-ray, an electrocardiogram, urinalysis, and an exercise test. The blood test or urinalysis in one embodiment is for measuring cholesterol, potassium, and/or blood sugar levels, and/or for detecting an infection or malfunction.

The nucleic acids and/or variants described herein, or nucleic acids comprising their complementary sequence, or portions or fragments thereof, may be used as antisense constructs to control gene expression in cells, tissues or organs. Such antisense agents may be useful for therapy of eosinophilia, asthma, myocardial infarction, and/or hypertension. The methodology associated with antisense techniques is well known to the skilled artisan, and is for example described and reviewed in *AntisenseDrug Technology: Principles, Strategies, and Applications*, Crooke, ed., Marcel Dekker Inc., New York (2001). In general, antisense agents (antisense oligonucleotides) are comprised of single stranded oligonucleotides (RNA or DNA) that are capable of binding to a complimentary nucleotide segment. By binding the appropriate target sequence, an RNA-RNA, DNA-DNA or RNA-DNA duplex is formed. The antisense oligonucleotides are complementary to the sense or coding strand of a gene. It is also possible to form a triple helix, where the antisense oligonucleotide binds to duplex DNA.

Several classes of antisense oligonucleotide are known to those skilled in the art, including cleavers and blockers. The former bind to target RNA sites, activate intracellular nucleases (e.g., RnaseH or Rnase L), that cleave the target RNA. Blockers bind to target RNA, inhibit protein translation by steric hindrance of the ribosomes. Examples of blockers include nucleic acids, morpholino compounds, locked nucleic acids and methylphosphonates (Thompson, *Drug Discovery Today*, 7:912-917 (2002)). Antisense oligonucleotides are useful directly as therapeutic agents, and are also useful for determining and validating gene function, for example by gene knock-out or gene knock-down experiments. Antisense technology is further described in Layery et al., *Curr. Opin. Drug Discov. Devel.* 6:561-569 (2003), Stephens et al., *Curr. Opin. Mol. Ther.* 5:118-122 (2003), Kurreck, *Eur. J. Biochem.* 270:1628-44 (2003), Dias et al., *Mol. Cancer. Ter.* 1:347-55 (2002), Chen, *Methods Mol. Med.* 75:621-636 (2003), Wang et al., *Curr. Cancer Drug Targets* 1:177-96 (2001), and Bennett, Antisense Nucleic Acid Drug. Dev. 12:215-24 (2002).

In certain embodiments, the antisense agent is an oligonucleotide that is capable of binding to a nucleotide segment of a particular gene. Antisense nucleotides can be from 5-500 nucleotides in length, including 5-200 nucleotides, 5-100 nucleotides, 10-50 nucleotides, and 10-30 nucleotides. All integer lengths from 5-500 are specifically contemplated for the present invention, as are all subranges of lengths. In certain preferred embodiments, the antisense nucleotides is from 14-50 nucleotides in length, including 14-40 nucleotides and 14-30 nucleotides. In certain such embodiments, the antisense nucleotide is capable of binding to a nucleotide segment of the a gene selected from the group consisting of .ATP9A, ATXN2, BAX, CUX2, IL1RL1, IL33, LBH, LOC441108, PTPN11, RAD50, RAD51L1, SH2B3, SLC22A4, SNX6, TBC1D8, TNKS2, TNXB, BRAP, ACAD10, ALDH2, MAPKAPK5, and ERP29.

The variants described herein can also be used for the selection and design of antisense reagents that are specific for particular variants. Using information about the variants described herein, antisense oligonucleotides or other antisense molecules that specifically target mRNA molecules that contain one or more variants of the invention can be designed. In this manner, expression of mRNA molecules that contain one or more variant of the present invention (markers and/or haplotypes) can be inhibited or blocked. In one embodiment, the antisense molecules are designed to specifically bind a particular allelic form (i.e., one or several variants (alleles and/or haplotypes)) of the target nucleic acid, thereby inhibiting translation of a product originating from this specific allele or haplotype, but which do not bind other or alternate variants at the specific polymorphic sites of the target nucleic acid molecule.

As antisense molecules can be used to inactivate mRNA so as to inhibit gene expression, and thus protein expression, the molecules can be used for disease treatment. The methodology can involve cleavage by means of ribozymes containing nucleotide sequences complementary to one or more regions in the mRNA that attenuate the ability of the mRNA to be translated. Such mRNA regions include, for example, protein-coding regions, in particular protein-coding regions corresponding to catalytic activity, substrate and/or ligand binding sites, or other functional domains of a protein.

The phenomenon of RNA interference (RNAi) has been actively studied for the last decade, since its original discovery in *C. elegans* (Fire et al., *Nature* 391:806-11 (1998)), and in recent years its potential use in treatment of human disease has been actively pursued (reviewed in Kim & Rossi, *Nature Rev. Genet.* 8:173-204 (2007)). RNA interference (RNAi), also called gene silencing, is based on using double-stranded RNA molecules (dsRNA) to turn off specific genes. In the cell, cytoplasmic double-stranded RNA molecules (dsRNA) are processed by cellular complexes into small interfering RNA (siRNA). The siRNA guide the targeting of a protein-RNA complex to specific sites on a target mRNA, leading to cleavage of the mRNA (Thompson, *Drug Discovery Today*, 7:912-917 (2002)). The siRNA molecules are typically about 20, 21, 22 or 23 nucleotides in length. Thus, one aspect of the invention relates to isolated nucleic acid molecules, and the use of those molecules for RNA interference, i.e. as small interfering RNA molecules (siRNA). In one embodiment, the isolated nucleic acid molecules are 18-26 nucleotides in length, preferably 19-25 nucleotides in length, more preferably 20-24 nucleotides in length, and more preferably 21, 22 or 23 nucleotides in length.

Another pathway for RNAi-mediated gene silencing originates in endogenously encoded primary microRNA (pri-miRNA) transcripts, which are processed in the cell to generate precursor miRNA (pre-miRNA). These miRNA molecules are exported from the nucleus to the cytoplasm, where they undergo processing to generate mature miRNA molecules (miRNA), which direct translational inhibition by recognizing target sites in the 3' untranslated regions of mRNAs, and subsequent mRNA degradation by processing P-bodies (reviewed in Kim & Rossi, Nature Rev. Genet. 8:173-204 (2007)).

Clinical applications of RNAi include the incorporation of synthetic siRNA duplexes, which preferably are approximately 20-23 nucleotides in size, and preferably have 3' overlaps of 2 nucleotides. Knockdown of gene expression is established by sequence-specific design for the target mRNA. Several commercial sites for optimal design and synthesis of such molecules are known to those skilled in the art.

Other applications provide longer siRNA molecules (typically 25-30 nucleotides in length, preferably about 27 nucleotides), as well as small hairpin RNAs (shRNAs; typically about 29 nucleotides in length). The latter are naturally expressed, as described in Amarzguioui et al. (*FEBS Lett.* 579:5974-81 (2005)). Chemically synthetic siRNAs and shRNAs are substrates for in vivo processing, and in some cases provide more potent gene-silencing than shorter designs (Kim et al., *Nature Biotechnol.* 23:222-226 (2005); Siolas et al., *Nature Biotechnol.* 23:227-231 (2005)). In general siRNAs provide for transient silencing of gene expression, because their intracellular concentration is diluted by subsequent cell divisions. By contrast, expressed shRNAs mediate long-term, stable knockdown of target transcripts, for as long as transcription of the shRNA takes place (Marques et al., *Nature Biotechnol.* 23:559-565 (2006); Brummelkamp et al., *Science* 296: 550-553 (2002)).

Since RNAi molecules, including siRNA, miRNA and shRNA, act in a sequence-dependent manner, the variants presented herein (e.g., the markers and haplotypes set forth in Table 3) can be used to design RNAi reagents that recognize specific nucleic acid molecules comprising specific alleles and/or haplotypes (e.g., the alleles and/or haplotypes of the present invention), while not recognizing nucleic acid molecules comprising other alleles or haplotypes. These RNAi reagents can thus recognize and destroy the target nucleic acid molecules. As with antisense reagents, RNAi reagents can be useful as therapeutic agents (i.e., for turning off disease-associated genes or disease-associated gene variants), but may also be useful for characterizing and validating gene function (e.g., by gene knock-out or gene knock-down experiments).

Delivery of RNAi may be performed by a range of methodologies known to those skilled in the art. Methods utilizing non-viral delivery include cholesterol, stable nucleic acid-lipid particle (SNALP), heavy-chain antibody fragment (Fab), aptamers and nanoparticles. Viral delivery methods include use of lentivirus, adenovirus and adeno-associated virus. The siRNA molecules are in some embodiments chemically modified to increase their stability. This can include modifications at the 2' position of the ribose, including 2'-O-methylpurines and 2'-fluoropyrimidines, which provide resistance to Rnase activity. Other chemical modifications are possible and known to those skilled in the art.

The following references, incorporated herein by reference, provide a further summary of RNAi, and possibilities for targeting specific genes using RNAi: Kim & Rossi, *Nat. Rev. Genet.* 8:173-184 (2007), Chen & Rajewsky, *Nat. Rev. Genet.* 8: 93-103 (2007), Reynolds, et al., *Nat. Biotechnol.* 22:326-330 (2004), Chi et al., *Proc. Natl. Acad. Sci. USA* 100:6343-6346 (2003), Vickers et al., *J. Biol. Chem.* 278: 7108-7118 (2003), Agami, *Curr. Opin. Chem. Biol.* 6:829-834 (2002), Layery, et al., *Curr. Opin. Drug Discov. Devel.* 6:561-569 (2003), Shi, *Trends Genet.* 19:9-12 (2003), Shuey et al., *Drug Discov. Today* 7:1040-46 (2002), McManus et al., *Nat. Rev. Genet.* 3:737-747 (2002), Xia et al., *Nat. Biotechnol.* 20:1006-10 (2002), Plasterk et al., *curr. Opin. Genet. Dev.* 10:562-7 (2000), Bosher et al., *Nat. Cell Biol.* 2:E31-6 (2000), and Hunter, *Curr. Biol.* 9:R440-442 (1999).

Kits

Kits useful in the methods of the invention comprise components useful in any of the methods described herein, including for example, primers for nucleic acid hybridization, hybridization probes, restriction enzymes (e.g., for RFLP analysis), allele-specific oligonucleotides, antibodies that bind to an altered polypeptide encoded by a nucleic acid of the invention as described herein (e.g., a genomic segment comprising at least one polymorphic marker and/or haplotype of the present invention) or to a non-altered (native) polypeptide encoded by a nucleic acid of the invention as described herein, reagents for amplification of a nucleic acid associated with eosinophilia, asthma, myocardial infarction, and/or hypertension reagents for analyzing the nucleic acid sequence of a nucleic acid associated with eosinophilia, asthma, myocardial infarction, and/or hypertension, reagents for analyzing the amino acid sequence of a polypeptide encoded by a nucleic acid associated with eosinophilia, asthma, myocardial infarction, and/or hypertension, etc. The kits can for example include necessary buffers, nucleic acid primers for amplifying nucleic acids of the invention (e.g., a nucleic acid segment comprising one or more of the polymorphic markers as described herein), and reagents (including enzymes) for allele-specific detection of the fragments amplified using such primers and necessary enzymes (e.g., DNA polymerase). Additionally, kits can provide reagents for assays to be used in combination with the methods of the invention, e.g., reagents for use with other eosinophilia, asthma, myocardial infarction, and/or hypertension diagnostic assays. The kit may furthermore include a collection of data comprising correlation data between the polymorphic markers assessed by the kit and susceptibility to eosinophilia, asthma myocardial infarction, and/or hypertension.

In one embodiment, the invention is a kit for assaying a sample from a subject to detect the presence of genetic polymorphisms causative or correlative/associated with eosinophilia, asthma, myocardial infarction, and/or hypertension symptoms associated with eosinophilia, asthma, myocardial infarction, and/or hypertension, or a susceptibility to eosinophilia, asthma, myocardial infarction, and/or hypertension in a subject, wherein the kit comprises reagents necessary for selectively detecting at least one allele of at least one polymorphism of the invention in the genome of the individual. In a particular embodiment, the reagents comprise at least one contiguous oligonucleotide that hybridizes to a fragment of the genome of the individual comprising at least one polymorphism of the invention. In another embodiment, the reagents comprise at least one pair of oligonucleotides that hybridize to opposite strands of a genomic segment obtained from a subject, wherein each oligonucleotide primer pair is designed to selectively amplify a fragment of the genome of the individual that includes at least one polymorphism, wherein the polymorphism is selected from the group consisting of the polymorphisms as listed in Table 3, 4, 6, 7, 10, 13, or 14, and polymorphic markers in linkage disequilibrium therewith (e.g., the markers listed in Table 8). In yet another embodiment the fragment is at least 20 base pairs in size. Such oligonucleotides or nucleic acids (e.g., oligonucleotide primers) can be designed using portions of the nucleic acid sequence flanking polymorphisms (e.g., SNPs or microsatellites) that are indicative of increased or decreased risk of eosinophilia, asthma, myocardial infarction, and/or hypertension. In another embodiment, the kit comprises one or more labeled nucleic acids capable of allele-specific detection of one or more specific polymorphic markers or haplotypes associated with increased or decreased risk of eosinophilia, asthma, myocardial infarction, and/or hypertension, and reagents for detection of the label. Suitable labels include, e.g., a radioisotope, a fluorescent label, an enzyme label, an enzyme co-factor label, a magnetic label, a spin label, an epitope label.

In particular embodiments, the polymorphic marker or haplotype to be detected by the reagents of the kit comprises reagents for analyzing one or more markers, two or more markers, three or more markers, four or more markers or five or more markers selected from the group consisting of the markers in Table 3, 4, 6, 7, 10, 13, and/or 14. In another embodiment, the marker or haplotype to be detected comprises the markers listed in Table 3. In another embodiment, the marker or haplotype to be detected comprises the markers listed in Table 4, 6 and/or 7. In another embodiment, the marker or haplotype to be detected comprises at least one marker selected from the markers set forth in Table 10 or 13 and/or 14.

In one preferred embodiment, the kit for detecting the markers of the invention comprises a detection oligonucleotide probe, that hybridizes to a segment of template DNA containing a SNP polymorphisms to be detected, an enhancer oligonucleotide probe and an endonuclease. As explained in the above, the detection oligonucleotide probe comprises a fluorescent moiety or group at its 3' terminus and a quencher at its 5' terminus, and an enhancer oligonucleotide, is employed, as described by Kutyavin et al. (Nucleic Acid Res. 34:e128 (2006)). The fluorescent moiety can be Gig Harbor Green or Yakima Yellow, or other suitable fluorescent moieties. The detection probe is designed to hybridize to a short nucleotide sequence that includes the SNP polymorphism to be detected. In one embodiment, the SNP is anywhere from the terminal residue to −6 residues from the 3' end of the detection probe. The enhancer is a short oligonucleotide probe which hybridizes to the DNA template 3' relative to the detection probe. The probes are designed such that a single nucleotide gap exists between the detection probe and the enhancer nucleotide probe when both are bound to the template. The gap creates a synthetic abasic site that is recognized by an endonuclease, such as Endonuclease IV. The enzyme cleaves the dye off the fully complementary detection probe, but cannot cleave a detection probe containing a mismatch. Thus, by measuring the fluorescence of the released fluorescent moiety, assessment of the presence of a particular allele defined by nucleotide sequence of the detection probe can be performed.

The detection probe can be of any suitable size, although preferably the probe is relatively short. In one embodiment, the probe is from 5-100 nucleotides in length. In another embodiment, the probe is from 10-50 nucleotides in length, and in another embodiment, the probe is from 12-30 nucleotides in length. Other lengths of the probe are possible and within scope of the skill of the average person skilled in the art.

In a preferred embodiment, the DNA template containing the SNP polymorphism is amplified by Polymerase Chain Reaction (PCR) prior to detection, and primers for such amplification are included in the reagent kit. In such an embodiment, the amplified DNA serves as the template for the detection probe and the enhancer probe.

Certain embodiments of the detection probe, the enhancer probe, and/or the primers used for amplification of the template by PCR include the use of modified bases, including modified A and modified G. The use of modified bases can be useful for adjusting the melting temperature of the nucleotide molecule (probe and/or primer) to the template DNA, for example for increasing the melting temperature in regions containing a low percentage of G or C bases, in which modified A with the capability of forming three hydrogen bonds to its complementary T can be used, or for decreasing the melting temperature in regions containing a high percentage of G or C bases, for example by using modified G bases that form only two hydrogen bonds to their complementary C base in a double stranded DNA molecule. In a specific embodiment, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In one of such embodiments, the presence of the marker or haplotype is indicative of a susceptibility (increased susceptibility or decreased susceptibility) to eosinophilia, asthma, myocardial infarction, and/or hypertension. In another embodiment, the presence of the marker or haplotype is indicative of response to a eosinophilia, asthma, myocardial infarction, and/or hypertension therapeutic agent. In another embodiment, the presence of the marker or haplotype is indicative eosinophilia, asthma, myocardial infarction, and/or hypertension prognosis. In yet another embodiment, the presence of the marker or haplotype is indicative of progress of eosinophilia, asthma, myocardial infarction, and/or hypertension treatment. Such treatment may include intervention by surgery, medication or by other means (e.g., lifestyle changes).

In a further aspect of the present invention, a pharmaceutical pack (kit) is provided, the pack comprising a therapeutic agent and a set of instructions for administration of the therapeutic agent to humans diagnostically tested for one or more variants of the present invention, as disclosed herein. The therapeutic agent can be a small molecule drug, an antibody, a peptide, an antisense or RNAi molecule, or other therapeutic molecules. In one embodiment, an individual identified as a carrier of at least one variant of the present invention is instructed to take a prescribed dose of the therapeutic agent. In one such embodiment, an individual identified as a homozygous carrier of at least one variant of the present invention is instructed to take a prescribed dose of the therapeutic agent. In another embodiment, an individual identified as a non-carrier of at least one variant of the present invention is instructed to take a prescribed dose of the therapeutic agent.

In certain embodiments, the kit further comprises a set of instructions for using the reagents comprising the kit.

Nucleic Acids

The nucleic acids and polypeptides described herein can be used in methods and kits of the invention, as described in the above.

An "isolated" nucleic acid molecule, as used herein, is one that is separated from nucleic acids that normally flank the gene or nucleotide sequence (as in genomic sequences) and/or has been completely or partially purified from other transcribed sequences (e.g., as in an RNA library). For example, an isolated nucleic acid of the invention can be substantially isolated with respect to the complex cellular milieu in which it naturally occurs, or culture medium when produced by recombinant techniques, or chemical precursors or other chemicals when chemically synthesized. In some instances, the isolated material will form part of a composition (for example, a crude extract containing other substances), buffer system or reagent mix. In other circumstances, the material can be purified to essential homogeneity, for example as determined by polyacrylamide gel electrophoresis (PAGE) or column chromatography (e.g., HPLC). An isolated nucleic acid molecule of the invention can comprise at least about 50%, at least about 80% or at least about 90% (on a molar basis) of all macromolecular species present. With regard to genomic DNA, the term "isolated" also can refer to nucleic acid molecules that are separated from the chromosome with which the genomic DNA is naturally associated. For example, the isolated nucleic acid molecule can contain less than about 250 kb, 200 kb, 150 kb, 100 kb, 75 kb, 50 kb, 25 kb, 10 kb, 5 kb, 4 kb, 3 kb, 2 kb, 1 kb, 0.5 kb or 0.1 kb of the nucleotides that flank the nucleic acid molecule in the genomic DNA of the cell from which the nucleic acid molecule is derived.

The nucleic acid molecule can be fused to other coding or regulatory sequences and still be considered isolated. Thus, recombinant DNA contained in a vector is included in the definition of "isolated" as used herein. Also, isolated nucleic acid molecules include partially or substantially purified DNA molecules in solution. "Isolated" nucleic acid molecules also encompass in vitro RNA transcripts of the DNA molecules of the invention. An isolated nucleic acid molecule or nucleotide sequence can include a nucleic acid molecule or nucleotide sequence that is synthesized chemically or by recombinant means. Such isolated nucleotide sequences are useful, for example, in the manufacture of the encoded polypeptide, as probes for isolating homologous sequences (e.g., from other mammalian species), for gene mapping (e.g., by in situ hybridization with chromosomes), or for detecting expression of the gene in tissue (e.g., human tissue), such as by Northern blot analysis or other hybridization techniques.

The invention also pertains to nucleic acid molecules that hybridize under high stringency hybridization conditions, such as for selective hybridization, to a nucleotide sequence described herein (e.g., nucleic acid molecules that specifically hybridize to a nucleotide sequence containing a polymorphic site associated with a marker or haplotype described herein). Such nucleic acid molecules can be detected and/or isolated by allele- or sequence-specific hybridization (e.g., under high stringency conditions). Stringency conditions and methods for nucleic acid hybridizations are well known to the skilled person (see, e.g., *Current Protocols in Molecular Biology*, Ausubel et al, *John Wiley & Sons*, (1998), and Kraus and Aaronson, *Methods Enzymol.*, 200:546-556 (1991), the entire teachings of which are incorporated by reference herein.

The percent identity of two nucleotide or amino acid sequences can be determined by aligning the sequences for optimal comparison purposes (e.g., gaps can be introduced in the sequence of a first sequence). The nucleotides or amino acids at corresponding positions are then compared, and the percent identity between the two sequences is a function of the number of identical positions shared by the sequences (i.e., % identity=# of identical positions/total # of positions× 100). In certain embodiments, the length of a sequence aligned for comparison purposes is at least 30%, at least 40%, at least 50%, at least 60%, at least 70%, at least 80%, at least 90%, or at least 95%, of the length of the reference sequence. The actual comparison of the two sequences can be accomplished by well-known methods, for example, using a mathematical algorithm. A non-limiting example of such a mathematical algorithm is described in Karlin, S, and Altschul, S., Proc. Natl. Acad. Sci. USA, 90:5873-5877 (1993). Such an algorithm is incorporated into the NBLAST and XBLAST programs (version 2.0), as described in Altschul, S. et al., Nucleic Acids Res., 25:3389-3402 (1997). When utilizing BLAST and Gapped BLAST programs, the default parameters of the respective programs (e.g., NBLAST) can be used. See the website on the world wide web at ncbi.nlm.nih.gov. In one embodiment, parameters for sequence comparison can be set at score=100, wordlength=12, or can be varied (e.g., W=5 or W=20).

Other examples include the algorithm of Myers and Miller, CABIOS (1989), ADVANCE and ADAM as described in Torellis, A. and Robotti, C., Comput. Appl. Biosci. 10:3-5 (1994); and FASTA described in Pearson, W. and Lipman, D., Proc. Natl. Acad. Sci. USA, 85:2444-48 (1988).

In another embodiment, the percent identity between two amino acid sequences can be accomplished using the GAP program in the GCG software package (Accelrys, Cambridge, UK).

The invention also provides isolated nucleic acid molecules that contain a fragment or portion that hybridizes under highly stringent conditions to a nucleic acid that comprises, or consists of, the nucleotide sequence of a gene selected from the group consisting of ATP9A, ATXN2, BAX, CUX2, IL1RL1, IL33, LBH, LOC441108, PTPN11, RAD50, RAD51L1, SH2B3, SLC22A4, SNX6, TBC1D8, TNKS2, TNXB, BRAP, ACAD10, ALDH2, MAPKAPK5, and ERP29, or a nucleotide sequence comprising, or consisting of, the complement of the nucleotide sequence of the gene, wherein the nucleotide sequence comprises at least one polymorphic allele contained in the markers and haplotypes described herein.

The invention further provides isolated nucleic acid molecules that contain a fragment or portion that hybridizes under highly stringent conditions to a nucleic acid comprising a nucleotide sequence of any of SEQ ID NOs: 1-681, each of which sequences comprise one of the polymorphic markers associated with eosinophilia, asthma, myocardial infarction, or hypertension, as described herein. Such nucleic acid molecules, e.g., oligonucleotide probes, can be used in the manufacture of a diagnostic reagent for diagnosing and/or assessing susceptibility to eosinophilia, asthma, myocardial infarction, or hypertension.

The nucleic acid fragments of the invention are at least about 15, at least about 18, 20, 23 or 25 nucleotides, and can be 30, 40, 50, 100, 200, 500, 1000, 10,000 or more nucleotides in length. In a specific embodiment, the nucleic acid fragments are 15-500 nucleotides in length.

The nucleic acid fragments of the invention are used as probes or primers in assays such as those described herein. "Probes" or "primers" are oligonucleotides that hybridize in a base-specific manner to a complementary strand of a nucleic acid molecule. In addition to DNA and RNA, such probes and primers include polypeptide nucleic acids (PNA), as described in Nielsen et al., *Science* 254:1497-1500 (1991). A probe or primer comprises a region of nucleotide sequence that hybridizes to at least about 15, typically about 20-25, and in certain embodiments about 40, 50 or 75, consecutive nucleotides of a nucleic acid molecule. In one embodiment, the probe or primer comprises at least one allele of at least one polymorphic marker or at least one haplotype described herein, or the complement thereof. In particular embodiments, a probe or primer can comprise 100 or fewer nucleotides; for example, in certain embodiments from 6 to 50 nucleotides, or, for example, from 12 to 30 nucleotides. In other embodiments, the probe or primer is at least 70% identical, at least 80% identical, at least 85% identical, at least 90% identical, or at least 95% identical, to the contiguous nucleotide sequence or to the complement of the contiguous nucleotide sequence. In another embodiment, the probe or primer is capable of selectively hybridizing to the contiguous nucleotide sequence or to the complement of the contiguous nucleotide sequence. Often, the probe or primer further comprises a label, e.g., a radioisotope, a fluorescent label, an enzyme label, an enzyme co-factor label, a magnetic label, a spin label, an epitope label.

The nucleic acid molecules of the invention, such as those described above, can be identified and isolated using standard molecular biology techniques well known to the skilled person. The amplified DNA can be labeled (e.g., radiolabeled) and used as a probe for screening a cDNA library derived from human cells. The cDNA can be derived from mRNA and contained in a suitable vector. Corresponding clones can be isolated, DNA can obtained following in vivo excision, and the cloned insert can be sequenced in either or both orientations by art-recognized methods to identify the correct reading frame encoding a polypeptide of the appropriate molecular weight. Using these or similar methods, the polypeptide and the DNA encoding the polypeptide can be isolated, sequenced and further characterized.

In general, the isolated nucleic acid sequences of the invention can be used as molecular weight markers on Southern gels, and as chromosome markers that are labeled to map related gene positions. The nucleic acid sequences can also be used to compare with endogenous DNA sequences in patients to identify polymorphisms causative of or correlated/associated with eosinophilia, asthma, myocardial infarction, and/or hypertension, and as probes, such as to hybridize and discover related DNA sequences or to subtract out known sequences from a sample (e.g., subtractive hybridization). The nucleic acid sequences can further be used to derive primers for genetic fingerprinting, to raise anti-polypeptide antibodies using immunization techniques, and/or as an antigen to raise anti-DNA antibodies or elicit immune responses.

Antibodies

The invention also provides antibodies which bind to an epitope comprising either a variant amino acid sequence (e.g., comprising an amino acid substitution) encoded by the variant allele or the reference amino acid sequence encoded by the corresponding non-variant or wild-type allele. For example, if a variant allele encodes an amino acid sequence comprising the epitope CYSTWFEH, wherein the T is an amino acid substitution from the native or wild-type A, the antibody of the invention specifically binds to either the epitope CYSTWFEH or CYSAWFEH. The term "antibody" as used herein refers to an immunoglobulin molecule, or an immunologically active portion of the immunoglobulin molecule, i.e., molecules that contain antigen-binding sites that specifically bind an antigen. A molecule that specifically binds to an epitope is a molecule that binds to that eptiope, but does not substantially bind other epitopes in a sample, e.g., a biological sample, which naturally contains the epitope. Examples of immunologically active portions of immunoglobulin molecules include F(ab) and F(ab')2 fragments which can be generated by treating the antibody with an enzyme such as pepsin.

The antibody can be polyclonal or monoclonal. The term "monoclonal antibody" or "monoclonal antibody composition", as used herein, refers to a population of antibody molecules that contain only one species of an antigen binding site capable of immunoreacting with a particular epitope of the invention. A monoclonal antibody composition thus typically displays a single binding affinity for a particular epitope of the invention with which it immunoreacts.

Polyclonal antibodies can be prepared by immunizing a suitable subject with a desired immunogen, e.g., polypeptide comprising the epitope of the invention or a fragment thereof. The antibody titer in the immunized subject can be monitored over time by standard techniques, such as with an enzyme linked immunosorbent assay (ELISA) using immobilized polypeptide. If desired, the antibody molecules directed against the polypeptide can be isolated from the mammal (e.g., from the blood) and further purified by well-known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybridoma technique originally described by Kohler and Milstein, Nature 256:495-497 (1975), the human B cell hybridoma technique (Kozbor et al., *Immunol. Today* 4: 72 (1983)), the EBV-hybridoma technique (Cole et al., *Monoclonal Antibodies and Cancer Therapy*, Alan R. Liss, 1985, Inc., pp. 77-96) or trioma techniques. The technology for producing hybridomas is well known (see generally *Current Protocols in Immunology* (1994) Coligan et al., (eds.) John Wiley & Sons, Inc., New York, N.Y.). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds a polypeptide of the invention.

Any of the many well known protocols used for fusing lymphocytes and immortalized cell lines can be applied for the purpose of generating a monoclonal antibody to a polypeptide of the invention (see, e.g., Current Protocols in Immunology, supra; Galfre et al., Nature 266:55052 (1977); R. H. Kenneth, in Monoclonal Antibodies: A New Dimension In Biological Analyses, Plenum Publishing Corp., New York, N.Y. (1980); and Lerner, Yale J. Biol. Med. 54:387-402 (1981)). Moreover, the ordinarily skilled worker will appreciate that there are many variations of such methods that also would be useful.

Alternative to preparing monoclonal antibody-secreting hybridomas, a monoclonal antibody to a polypeptide of the invention can be identified and isolated by screening a recombinant combinatorial immunoglobulin library (e.g., an antibody phage display library) with the polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP™ Phage Display Kit, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al., Bio/Technology 9: 1370-1372 (1991); Hay et al., Hum. Antibod. Hybridomas 3:81-85 (1992); Huse et al., Science 246: 1275-1281 (1989); and Griffiths et al., EMBO J. 12:725-734 (1993).

Additionally, recombinant antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art.

In general, antibodies of the invention (e.g., a monoclonal antibody) can be used to isolate a polypeptide by standard techniques, such as affinity chromatography or immunoprecipitation. A polypeptide-specific antibody can facilitate the purification of natural polypeptide from cells and of recombinantly produced polypeptide expressed in host cells. Moreover, an antibody specific for an epitope of the invention can be used to detect the polypeptide (e.g., in a cellular lysate, cell supernatant, or tissue sample) in order to evaluate the abundance and pattern of expression of the polypeptide. Antibodies can be used diagnostically to monitor protein levels in tissue as part of a clinical testing procedure, e.g., to, for example, determine the efficacy of a given treatment regimen. The antibody can be coupled to a detectable substance to facilitate its detection. Examples of detectable substances include various enzymes, prosthetic groups, fluorescent materials, luminescent materials, bioluminescent materials, and radioactive materials. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include 125I, 131I, 35S or 3H.

Antibodies may also be useful in pharmacogenomic analysis. In such embodiments, antibodies against variant proteins encoded by nucleic acids according to the invention, such as variant proteins that are encoded by nucleic acids that contain at least one polymorphic marker of the invention, can be used to identify individuals that require modified treatment modalities.

Antibodies can furthermore be useful for assessing expression of variant proteins in disease states, such as in active stages of a disease, or in an individual with a predisposition to a disease related to the function of a protein encoded by a gene associated with eosinophilia, asthma, myocardial infarction, and/or hypertension. Antibodies specific for a variant protein encoded by a nucleic acid that comprises at least one polymorphic marker or haplotype as described herein can be used to screen for the presence of the variant protein, for example to screen for a predisposition to eosinophilia, asthma, myocardial infarction, and/or hypertension, as indicated by the presence of the variant protein.

Antibodies can be used in other methods. Thus, antibodies are useful as diagnostic tools for evaluating proteins, such as variant proteins of the invention, in conjunction with analysis by electrophoretic mobility, isoelectric point, tryptic or other protease digest, or for use in other physical assays known to those skilled in the art. Antibodies may also be used in tissue typing. In one such embodiment, a specific variant protein has been correlated with expression in a specific tissue type, and antibodies specific for the variant protein can then be used to identify the specific tissue type.

Subcellular localization of proteins, including variant proteins, can also be determined using antibodies, and can be applied to assess aberrant subcellular localization of the protein in cells in various tissues. Such use can be applied in genetic testing, but also in monitoring a particular treatment modality. In the case where treatment is aimed at correcting the expression level or presence of the variant protein or aberrant tissue distribution or developmental expression of the variant protein, antibodies specific for the variant protein or fragments thereof can be used to monitor therapeutic efficacy.

The invention further relates to kits comprising the antibodies of the invention in the methods described herein. This includes, but is not limited to, kits for detecting the presence of a variant protein in a test sample. One preferred embodiment comprises antibodies such as a labeled or labelable antibody and a compound or agent for detecting variant proteins in a biological sample, means for determining the amount or the presence and/or absence of variant protein in the sample, and means for comparing the amount of variant protein in the sample with a standard, as well as instructions for use of the kit.

Computer-Readable Medium, Apparatus

The methods and information described herein may be implemented, in all or in part, as computer executable instructions on known computer-readable media. For example, the methods described herein may be implemented in hardware. Alternatively, the method may be implemented in software stored in, for example, one or more memories or other computer readable medium and implemented on one or more processors. The processors may be associated with one or more controllers, calculation units and/or other units of a computer system, or implanted in firmware as desired. If implemented in software, the routines may be stored in any computer readable memory such as in RAM, ROM, flash memory, a magnetic disk, a laser disk, or other storage medium, as is also known. Likewise, this software may be delivered to a computing device via any known delivery method including, for example, over a communication channel such as a telephone line, the Internet, a wireless connection, etc., or via a transportable medium, such as a computer readable disk, flash drive, etc.

More generally, and as understood by those of ordinary skill in the art, the various steps described above may be implemented as various blocks, operations, tools, modules and techniques which, in turn, may be implemented in hardware, firmware, software, or any combination of hardware, firmware, and/or software. When implemented in hardware, some or all of the blocks, operations, techniques, etc. may be implemented in, for example, a custom integrated circuit (IC), an application specific integrated circuit (ASIC), a field programmable logic array (FPGA), a programmable logic array (PLA), etc.

When implemented in software, the software may be stored in any known computer readable medium such as on a magnetic disk, an optical disk, or other storage medium, in a RAM or ROM or flash memory of a computer, processor, hard disk drive, optical disk drive, tape drive, etc. Likewise, the software may be delivered to a user or a computing system via any known delivery method including, for example, on a computer readable disk or other transportable computer storage mechanism.

Figure 6:
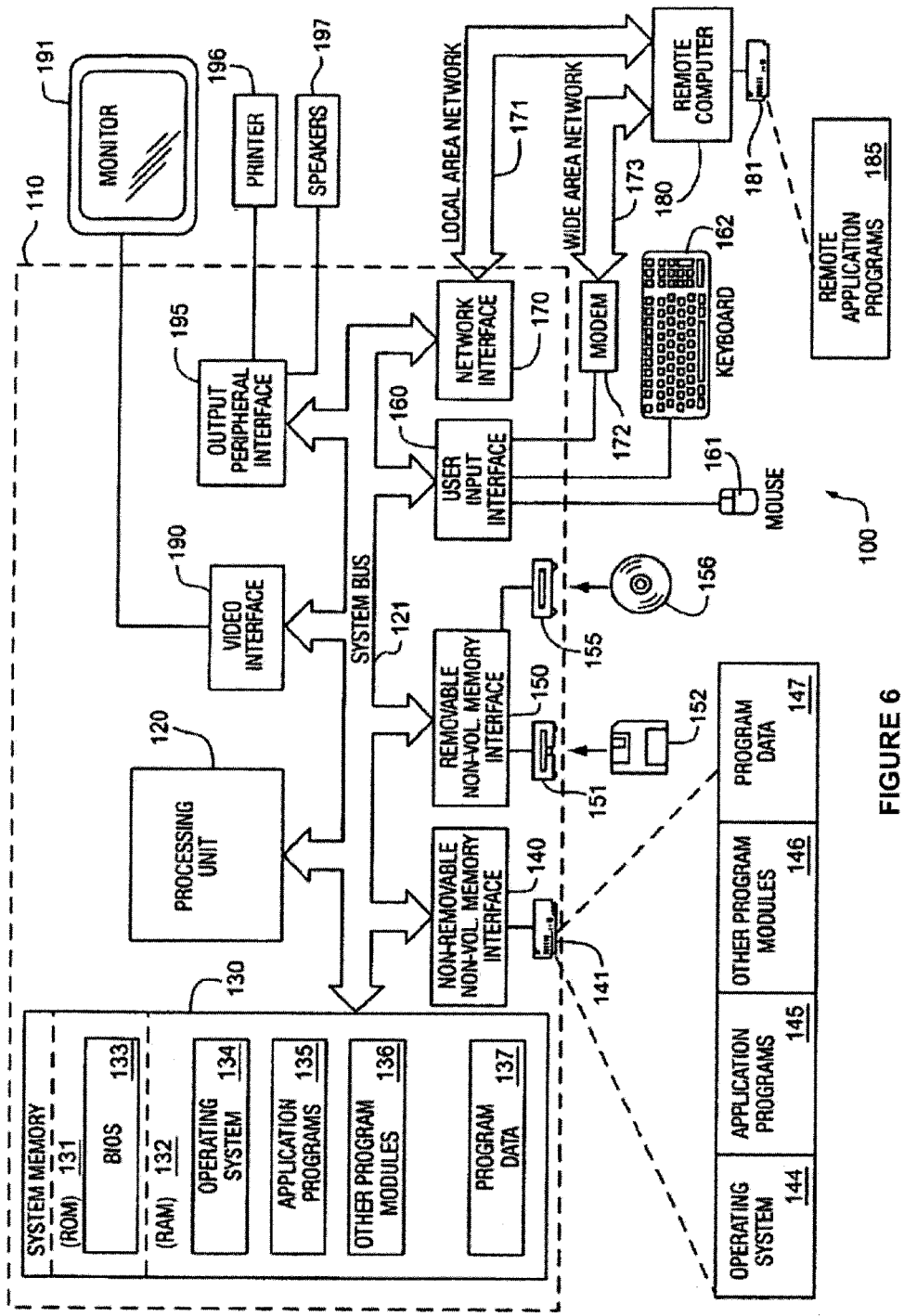
FIG. 6 shows an exemplary computer environment on which the methods and apparatus as described and claimed herein can be implemented.

FIG. 6 illustrates an example of a suitable computing system environment 100 on which a system for the steps of the claimed method and apparatus may be implemented. The computing system environment 100 is only one example of a suitable computing environment and is not intended to suggest any limitation as to the scope of use or functionality of the method or apparatus of the claims. Neither should the computing environment 100 be interpreted as having any dependency or requirement relating to any one or combination of components illustrated in the exemplary operating environment 100.

The steps of the claimed method and system are operational with numerous other general purpose or special purpose computing system environments or configurations. Examples of well known computing systems, environments, and/or configurations that may be suitable for use with the methods or system of the claims include, but are not limited to, personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, and the like.

The steps of the claimed method and system may be described in the general context of computer-executable instructions, such as program modules, being executed by a computer. Generally, program modules include routines, programs, objects, components, data structures, etc. that perform particular tasks or implement particular abstract data types. The methods and apparatus may also be practiced in distributed computing environments where tasks are performed by remote processing devices that are linked through a communications network. In both integrated and distributed computing environments, program modules may be located in both local and remote computer storage media including memory storage devices.

With reference to FIG. 6, an exemplary system for implementing the steps of the claimed method and system includes a general purpose computing device in the form of a computer 110. Components of computer 110 may include, but are not limited to, a processing unit 120, a system memory 130, and a system bus 121 that couples various system components including the system memory to the processing unit 120. The system bus 121 may be any of several types of bus structures including a memory bus or memory controller, a peripheral bus, and a local bus using any of a variety of bus architectures. By way of example, and not limitation, such architectures include Industry Standard Architecture (USA) bus, Micro Channel Architecture (MCA) bus, Enhanced ISA (EISA) bus, Video Electronics Standards Association (VESA) local bus, and Peripheral Component Interconnect (PCI) bus also known as Mezzanine bus.

Computer 110 typically includes a variety of computer readable media. Computer readable media can be any available media that can be accessed by computer 110 and includes both volatile and nonvolatile media, removable and non-removable media. By way of example, and not limitation, computer readable media may comprise computer storage media and communication media. Computer storage media includes both volatile and nonvolatile, removable and non-removable media implemented in any method or technology for storage of information such as computer readable instructions, data structures, program modules or other data. Computer storage media includes, but is not limited to, RAM, ROM, EEPROM, flash memory or other memory technology, CD-ROM, digital versatile disks (DVD) or other optical disk storage, magnetic cassettes, magnetic tape, magnetic disk storage or other magnetic storage devices, or any other medium which can be used to store the desired information and which can accessed by computer 110. Communication media typically embodies computer readable instructions, data structures, program modules or other data in a modulated data signal such as a carrier wave or other transport mechanism and includes any information delivery media. The term "modulated data signal" means a signal that has one or more of its characteristics set or changed in such a manner as to encode information in the signal. By way of example, and not limitation, communication media includes wired media such as a wired network or direct-wired connection, and wireless media such as acoustic, RF, infrared and other wireless media. Combinations of the any of the above should also be included within the scope of computer readable media.

The system memory 130 includes computer storage media in the form of volatile and/or nonvolatile memory such as read only memory (ROM) 131 and random access memory (RAM) 132. A basic input/output system 133 (BIOS), containing the basic routines that help to transfer information between elements within computer 110, such as during start-up, is typically stored in ROM 131. RAM 132 typically contains data and/or program modules that are immediately accessible to and/or presently being operated on by processing unit 120. By way of example, and not limitation, FIG. 6 illustrates operating system 134, application programs 135, other program modules 136, and program data 137.

The computer 110 may also include other removable/non-removable, volatile/nonvolatile computer storage media. By way of example only, FIG. 6 illustrates a hard disk drive 140 that reads from or writes to non-removable, nonvolatile magnetic media, a magnetic disk drive 151 that reads from or writes to a removable, nonvolatile magnetic disk 152, and an optical disk drive 155 that reads from or writes to a removable, nonvolatile optical disk 156 such as a CD ROM or other optical media. Other removable/non-removable, volatile/nonvolatile computer storage media that can be used in the exemplary operating environment include, but are not limited to, magnetic tape cassettes, flash memory cards, digital versatile disks, digital video tape, solid state RAM, solid state ROM, and the like. The hard disk drive 141 is typically connected to the system bus 121 through a non-removable memory interface such as interface 140, and magnetic disk drive 151 and optical disk drive 155 are typically connected to the system bus 121 by a removable memory interface, such as interface 150.

The drives and their associated computer storage media discussed above and illustrated in FIG. 6, provide storage of computer readable instructions, data structures, program modules and other data for the computer 110. In FIG. 6, for example, hard disk drive 141 is illustrated as storing operating system 144, application programs 145, other program modules 146, and program data 147. Note that these components can either be the same as or different from operating system 134, application programs 135, other program modules 136, and program data 137. Operating system 144, application programs 145, other program modules 146, and program data 147 are given different numbers here to illustrate that, at a minimum, they are different copies. A user may enter commands and information into the computer 20 through input devices such as a keyboard 162 and pointing device 161, commonly referred to as a mouse, trackball or touch pad. Other input devices (not shown) may include a microphone, joystick, game pad, satellite dish, scanner, or the like. These and other input devices are often connected to the processing unit 120 through a user input interface 160 that is coupled to the system bus, but may be connected by other interface and bus structures, such as a parallel port, game port or a universal serial bus (USB). A monitor 191 or other type of display device is also connected to the system bus 121 via an interface, such as a video interface 190. In addition to the monitor, computers may also include other peripheral output devices such as speakers 197 and printer 196, which may be connected through an output peripheral interface 190.

The computer 110 may operate in a networked environment using logical connections to one or more remote computers, such as a remote computer 180. The remote computer 180 may be a personal computer, a server, a router, a network PC, a peer device or other common network node, and typically includes many or all of the elements described above relative to the computer 110, although only a memory storage device 181 has been illustrated in FIG. 6. The logical connections depicted in FIG. 6 include a local area network (LAN) 171 and a wide area network (WAN) 173, but may also include other networks. Such networking environments are commonplace in offices, enterprise-wide computer networks, intranets and the Internet.

When used in a LAN networking environment, the computer 110 is connected to the LAN 171 through a network interface or adapter 170. When used in a WAN networking environment, the computer 110 typically includes a modem 172 or other means for establishing communications over the WAN 173, such as the Internet. The modem 172, which may be internal or external, may be connected to the system bus 121 via the user input interface 160, or other appropriate mechanism. In a networked environment, program modules depicted relative to the computer 110, or portions thereof, may be stored in the remote memory storage device. By way of example, and not limitation, FIG. 6 illustrates remote application programs 185 as residing on memory device 181. It will be appreciated that the network connections shown are exemplary and other means of establishing a communications link between the computers may be used.

Although the foregoing text sets forth a detailed description of numerous different embodiments of the invention, it should be understood that the scope of the invention is defined by the words of the claims set forth at the end of this patent. The detailed description is to be construed as exemplary only and does not describe every possibly embodiment of the invention because describing every possible embodiment would be impractical. Numerous alternative embodiments could be implemented, using either current technology or technology developed after the filing date of this patent, which would still fall within the scope of the claims defining the invention.

While some of the risk evaluation system and method, and other elements, have been described as optionally being implemented in software, they may be implemented in hardware, firmware, etc., and may be implemented by any other processor. Thus, the elements described herein may be implemented in a standard multi-purpose CPU or on specifically designed hardware or firmware such as an application-specific integrated circuit (ASIC) or other hard-wired device as desired, including, but not limited to, the computer 110 of FIG. 6. When implemented in software, the software routine may be stored in any computer readable memory such as on a magnetic disk, a laser disk, or other storage medium, in a RAM or ROM of a computer or processor, in any database, etc. Likewise, this software may be delivered to a user or a diagnostic system via any known or desired delivery method including, for example, on a computer readable disk or other transportable computer storage mechanism or over a communication channel such as a telephone line, the internet, wireless communication, etc. (which are viewed as being the same as or interchangeable with providing such software via a transportable storage medium).

Thus, many modifications and variations may be made in the techniques and structures described and illustrated herein without departing from the spirit and scope of the invention. Accordingly, it should be understood that the methods and apparatus described herein are illustrative only and are not limiting upon the scope of the invention.

The following examples further illustrate the invention but should not be construed as in any way limiting its scope.

EXAMPLES

A genome-wide association scan for sequence variants associating with the number of blood eosinophils was performed. The sequence variants were subsequently assessed for association of these variants with asthma and other inflammatory related diseases. FIG. 1 illustrates the overview of the study design, implementation and results.

The study was approved by the Icelandic Data Protection Commission and the National Bioethics Committee. All patients signed informed consent and donated blood samples. Personal identities of the patients and biological samples were encrypted by a third party system provided by the Data Protection Commission of Iceland.

The controls (41% males; mean age 61 years, SD=21) used in this study consisted of individuals from other ongoing genome-wide association studies at deCODE.

The following is a description of the populations used in the study:

Iceland—Asthma patients of both sexes over 18 years of age who attended an asthma clinic or emergency room at the National University Hospital of Iceland or the Iceland Medical Center (Laeknasetrid) during the years 1977 to 2008 were recruited. Asthma diagnosis was based on a combination of physician diagnosis, a positive reply to the question: "Has a doctor confirmed your asthma diagnosis?", questioners pertaining to asthma symptoms, and ICD diagnosis when receiving emergency care.

Atopy status was determined by assessing skin-prick test reactivity (wheal size >3 mm or >50% of the histamine control) to 12 common aeroallergens (Greer Laboratories, Lenoir, N.C., USA), and/or with specific serum IgE levels with UniCAP Phadiotop (Pharmacia Upjohn, Uppsala, Sweden) or RAST (Pharmacia Upjohn). Total serum IgE levels were measured by UniCAP FEIA (Pharmacia Upjohn). All patients provided informed consent and donated blood samples.

The coronary artery disease groups from Iceland have been described previously (Helgadottir et al., *Science* 316: 1491 (2007)).

Australia—The Australian case-control population has been described elsewhere (Kedda et al., *J. Allergy Gin. Immunol.* 113: 889 (2004)). Briefly, unrelated patients between 18 and 89 years of age with physician diagnosed asthma were recruited into the study. All subjects completed a comprehensive questionnaire and underwent clinical testing including assessment of lung function by spirometry and atopic status by skin prick testing. Atopy was defined as having a wheal reaction to allergen extract >3 mm to at least one of five common aeroallergens. Total serum IgE levels were measured by UniCAP FEIA (Pharmacia Upjohn). The control subjects had no history of asthma and did not undergo clinical testing. All participants gave written informed consent. The study protocol was approved by the Human Research Ethics Committee of the Sir Charles Gairdner Hospital, Western Australia.

The Netherlands—The Dutch cases have been previously described (Koppelman et al., *J. Allergy and Gin. Immunol.* 109: 498 (2002); Postma et al., *Am. J. Respir. Crit. Care Med.* 172: 446 (2005)). Briefly, asthma patients of European ancestry were initially studied between 1962 and 1975. At the time of recruitment and initial testing, all patients had asthma symptoms, were hyperresponsive to histamine ($PC_{20}$ histamine <32 mg/ml), and were younger than 45 years of age.

Between 1990 and 1999, patients were invited for follow-up tests: including pulmonary function, bronchial responsiveness to histamine, and total and specific serum IgE and skin tests to 16 common aero allergens (Koppelman et al., 2002, supra; Postma et al., 2005, supra). Participants were asked in advance to discontinue asthma or allergy medication, therapy with oral corticosteroids was however continued. The standardized British Medical Council questionnaire was used to assess the onset of symptoms of asthma (wheeze, dyspnea, asthma attacks) and patients were stratified accordingly as having early onset asthma (at age 18 or younger) or adult onset asthma (age 19 or older).

Controls were derived from Vlagtwedde/Vlaardingen cohort study, which is a general population-based cohort of adult subjects of European ancestry in the Netherlands. The recruitment started in 1965 with a follow-up of over 25 years. Surveys were performed every 3 years, in which information was collected on respiratory symptoms, smoking status, $FEV_1$, and allergy skin tests, as described (van Diemen et al., *Am. J. Respir. Crit. Care Med.* 172: 329 (2005)). The Medical Ethics Committee of the University Medical Center Groningen approved the studies, and all participants provided informed consent.

Korea—The Korean case-control sample has have been described elsewhere (Kim et al., *Genes Immun.* 8: 369 (2007)). Briefly, cases were recruited at the asthma clinics of two hospitals (Soonchuanhyang University Bucheon Hospital and Seoul Hospital). Asthma diagnosis was based on a history of recent respiratory symptoms and evidence of airway reversibility (greater than 15% increase of FEV following bronchodilation, <10/mg/ml PC20 metahcholine response, or greater than 20% increase of FEV1 following 2 weeks treatment with inhaled steroid). Asthma-free controls were recruited from the spouses of the patients and the general population. All the subjects were skin-prick tested for 24 common inhalant allergens. Atopy was defined as having a wheal reaction with the allergen extract equal to or greater than that with histamine (1 mg/ml) or 3 mm in diameter. Serum levels of total IgE were determined by using ImmunoCAP-specific IgE calibrators of the CAP system. (Pharmacia Diagnostics). The Institutional Review Boards of each of the hospitals approved the study and informed consent was obtained from all subjects. For these subjects eosinophil counts were available.

Hong Kong—All subjects are of southern Han Chinese ancestry residing in Hong Kong. The cohort consists of diabetes patients from The Prince of Wales Hospital diabetes registry (N=2,659) as well as a non-diabetic cohort consisting of subjects who were ascertained through a cardiovascular risk health screening program (N=597).

Great Britain—Asthmatic subjects and controls were selected from the Nottingham area from 3 study cohorts recruited over the period 1995-2008. Controls and doctor diagnosed asthmatics were selected from a large random population aged 18-65 (see (Britton et al., *Eur. Respir. J.* 7: 881 (1994)) for details). Selected matched controls had no history of asthma and had a negative methacholine challenge test. Additional cases of childhood asthma were included by using index cases from the Nottingham sib pair asthma study (Wheatley et al., *Hum. Mol. Genet.* 11: 2143 (2002)) and additional adult asthma cases were recruited from an ongoing study of asthma severity. Atopy was defined as the presence of 1 or more positive skin tests to common allergens (>2 mm over control). Severity assessment was based on British Thoracic Society guidelines (Thorax 58: i1 (2003)). Steps 1-2 was considered as mild, step 3 was considered as moderate and step 4-5 was considered as severe asthma. All subjects were of European ancestry. Local ethical committee approval was obtained for all 3 studies.

Germany I—The German case-control population consisted of children (aged 5-18 years) with suspected asthma recruited from the southwestern part of Germany between July 2000 and January 2005 (Henizmann et al., *J. Allergy and Gin. Immunol.* 112: 735 (2003)). The probands were characterized at the Centre of Pediatrics and Adolescent Medicine, Freiburg, Germany. The diagnosis of asthma was based on a history of respiratory symptoms, the use of anti-asthmatic medication and the presence of bronchial hyperresponsiveness (defined as a fall of at least 15% in baseline $FEV_1$ after either inhalation of mg/ml histamine or minutes of exercise provocation). Participants were asked in advance to discontinue any asthma or allergy medication before the clinical testing. Atopy status was determined by skin prick tests to 17 common allergens. Measurement of total serum IgE was carried out by using an enzyme allergosorbent test (Phadezym; Pharmacia, Uppsala, Sweden). The control sample consisted of subjects (aged 19-40 years) randomly chosen from the same area in the southwestern part of Germany and children recruited from clinics at the Centre of Pediatrics and Adolescent Medicine, Freiburg, Germany. No medical history was taken, and no medical testing was performed on the adult controls whereas the pediatric controls had no previous history of asthma, recurrent wheezing, atopic dermatitis or atopy. Approval was granted by the Ethical Commission of the University of Freiburg. A statement of informed consent was signed by all participants or signed by their parents in the case of children.

Germany II—The German sib-pair study consisted of two hundred and one families, consisting of at least two children with confirmed clinical asthma. Phenotyping was carried out by trained staff from more than 20 clinical center using the procedure as described previously (Wjst et al., *Genomics* 58: 1 (1999)). Atopy status was determined by skin prick test for 12 common aero allergens. Specific IgE was measured with 15 RAST assays using the CAP System RAST FEIA (Pharmacia Upjohn. Total serum IgE levels were measured by UniCAP FEIA (Pharmacia Upjohn). The ethics commission of "Nordrhein-Westfalen" approved all study methods and informed consent was obtained from all parents and children. Eosinophil counts were available for these subjects.

The sib-pairs from the Germany II sample set were analyzed assuming mendelian inheritance under the null hypothesis. Under the alternative transmission probabilities were defined by the multiplicative risk model and the allele frequencies. Un-transmitted parental alleles were used as controls. The number of un-transmitted parental genotypes corresponds to having on average genotyped 204 control individuals.

Sweden—Individuals 20-44 years of age were recruited from randomly selected population sample in Uppsala, Sweden. This was done as part of the European Community Respiratory Health Survey an internal epidemiologic survey comprising of participants from of 22 nations and 48 centers. Blood samples were collected and measurements included eosinophil counts (Janson et al., *J. Allergy Clin. Immunol.* 120: 673 (2007)). The eosinophil count was performed at the Department of Clinical Chemistry at Uppsala University Hospital on a Technichon H*I (Technicon, Chemicals Company, Tournai, Belgium).

Denmark—Asthma subjects and controls were selected and consecutively pooled for the present analysis from three studies at the Copenhagen Research Unit. Participants were aged 14 to 44 years and resided in Copenhagen, Denmark.

Subjects were selected if they had doctor diagnosed asthma by a respiratory specialist and had undergone a physical examination and spirometry.

United States—The coronary artery disease groups from the United States has been described previously (Helgadottir et al., 2007, supra).

Italy—The subjects from Verona were enrolled into the Verona Heart Study, which is an ongoing study aimed at identifying new risk factors for coronary artery disease (CAD) and myocardial infarction (MI) in a population of subjects with angiographic documentation of their coronary vessels. Details about the enrolment criteria have been described elsewhere (Girelli et al., *N. England J. Med.* 343: 774 (2000)).

In brief, the CAD group had angiographically documented severe coronary atherosclerosis, the majority of them being candidates for coronary artery bypass grafting or percutaneous coronary intervention. Control subjects were selected such that they had normal coronary arteries, being submitted to coronary angiography for reasons other than CAD. Controls with history or clinical evidence of atherosclerosis in vascular districts beyond the coronary bed were excluded. Information on MI diagnoses was gathered through medical records showing diagnostic electrocardiogram and enzyme changes, and/or the typical sequalae of MI on ventricular angiography. The study was approved by local Ethical Committee. Informed consent was obtained from all the patients after a full explanation of the study.

New Zealand—New Zealand CAD patients all had angiographically proven coronary artery stenosis $\geq 50\%$ of the vessel internal diameter in at least 1 vessel. The percentage diameter stenosis was visually estimated by an experienced cardiologist as the maximum percentage reduction in the vessel diameter expressed as a percentage of the angiographically normal adjacent vessel.

The extent of coronary artery disease was defined as the number of vessel territories (left anterior descending, left circumflex and right coronary arteries) with one or more stenoses of $\geq 50\%$ and expressed as single, double or triple vessel coronary artery disease. The American College of Cardiology/American Heart Association (ACC/AHA) classification was used to evaluate the morphology of coronary lesions at the index coronary angiogram. MI diagnoses was gathered through medical records showing diagnostic patterns on electrocardiogram and enzyme changes.

The New Zealand age matched controls had no history of ischemic heart disease, including angina pectoris (Jones et al., *Arterioscier Thromb Vasc Biol* 28: 764 (2008)). The study was approved by the local ethical committee and all participants gave written informed consent before being recruited.

The following is a description of the genotyping methods used in the study:

The Icelandic study participants were genotyped using genotyping systems and specialised software from Illumina (Human Hap300 and Human Hap300-duo+Bead Arrays, Illumina)(Barrett et al., *Nat Genet.* 38: 659 (2006)). In total, 311,388 single nucleotide polymorphism (SNP) markers, distributed across the human genome, were common to both platforms. For the association analysis, we used 304,226 SNP markers because 7,162 were deemed unusable due to low yield (<95% in at least one sample), deviations from Hardy-Weinberg expectations ($P<10^{-5}$ in at least one sample), or discrepancies in genotype frequencies between the arrays. The Dutch study participants were genotyped with the Illumina Human Hap300-duo+Bead Arrays. The American study participants were genotyped with the Human Hap1000 Bead Arrays.

Single SNP genotyping was carried out on the Centaurus (Nanogen) platform (Kutyavin et al., *Nucleic Acids Res* 34: e128 (2006)). The quality of each Centaurus SNP assay was evaluated by genotyping each assay in the CEU HapMap samples and comparing the results with the HapMap data. Assays with >1.5% mismatch rate were not used.

Because of lack of available DNA, only the SNPs showing potential association with asthma were genotyped on the Dutch asthma samples. Because of lack of SNP assay only three asthma samples were typed for rs12619285.

The following is a description of the quantitative association testing used in the study.

All blood measurements were standardized using quantile-quantile standardization and then corrected for year of birth (or age), sex, and age at measurement, where available, for each study population separately. In Iceland, year of birth was rounded to five years and used as a factor variable in the correction, but in the other populations a linear term in year of birth was used to correct the measurements.

For each SNP, a classical linear regression, using the genotype as an additive covariate and the standardized blood measurement as a response, was fit to test for association.

The test statistics from the Icelandic genome-wide scan were scaled by the method of genomic controls (Devlin et al., *Nat Genet.* 36: 1129-1130; author reply 1131 (2004)) using an estimate of 1.12 for blood eosinophil counts obtained by comparing the observed median of all $\chi^2$-test statistic to the value predicted by theory ($0.675^2$). The inflation factor in the combined Icelandic data set was estimated by simulating genotypes through the known Icelandic genealogy as 1.15 for blood eosinophil counts. The inflation factors for the other blood measurements were of similar magnitude.

Data from different sources were combined by estimating effective sample size from the observed effect sizes and P-values using standard meta-analysis techniques.

The following is a description of the case-control association testing used in the study.

The OR for each SNP allele or haplotype was calculated assuming the multiplicative model; i.e. assuming that the risk of a homozyogous carrier, relative to a non-carrier, is the square of the risk of a heterozygous carrier, relative to a non-carrier. Allelic frequencies and OR are presented for the markers. The associated P values were calculated with the standard likelihood ratio $\chi^2$ statistic as implemented in the NEMO software package (Gretarsdottier et al., *Nat Genet.* 35: 131-138 (e-publication Sep. 21, 2003). Confidence intervals were calculated assuming that the estimate of OR has a log-normal distribution.

Joint analyses of multiple case-control replication groups were carried out using a Mantel-Haenszel model in which the groups were allowed to have different population frequencies for alleles or genotypes but were assumed to have common relative risks. The tests of heterogeneity were performed by assuming that the allele frequencies were the same in all groups under the null hypothesis, but each group had a different allele frequency under the alternative hypothesis. Joint analyses of multiple groups of cases were performed using an extended Mantel-Haenszel model that corresponds to a polytomous logistic regression using the group indicator as a covariate.

Example 1

Circulating eosinophils were counted in 110,211 blood samples from 39,142 Icelanders seeking medical care at an Iceland Medical Center (Laeknasetrid), a clinic specializing in internal medicine, between the years 1997 and 2008. The measurements were performed in the Laboratory in Mjodd, RAM, Reykjavik, Iceland. Data from 469 blood samples were removed from the analysis because the sum of differential white blood cell counts were more than 2% from the directly counted number of white blood cells, leaving 109,742 measurements from 39,055 Icelanders. The circulating eosinophil numbers were standardized to a standard normal distribution using quantile-quantile standardization and then adjusted for sex, year of birth, and age at measurement.

In order to get an estimate for the quality of the adjusted circulating eosinophil numbers, we broke its variance (V) into two components, a between individual component (I) and a within individual, or residual, component (R), such that V=I+R. The I component captures the difference between individuals and is an upper bound for the fraction of variance that can be due to first order genetic factors. The R component captures the measurement variation and other variation observed between repeated measurements of the same individual. In general one would expect to underestimate R, due to measurements usually being taken over relatively short periods of a person's lifespan. R was estimated using the linear mixed-effect model (REF) and by direct estimation of the between measurement variance and estimates of 41% and 39%, respectively, were obtained. An individual in the data measured n times worth $1/(I+R/n)$ individuals measured only once. An individual measured 2 times is thus roughly equivalent to 1.25 individuals measured only once, and an individual measured 3 times is roughly equivalent to 1.36 individuals. In what follows effect sizes are given in percentages of standard deviation units.

Figure 2:
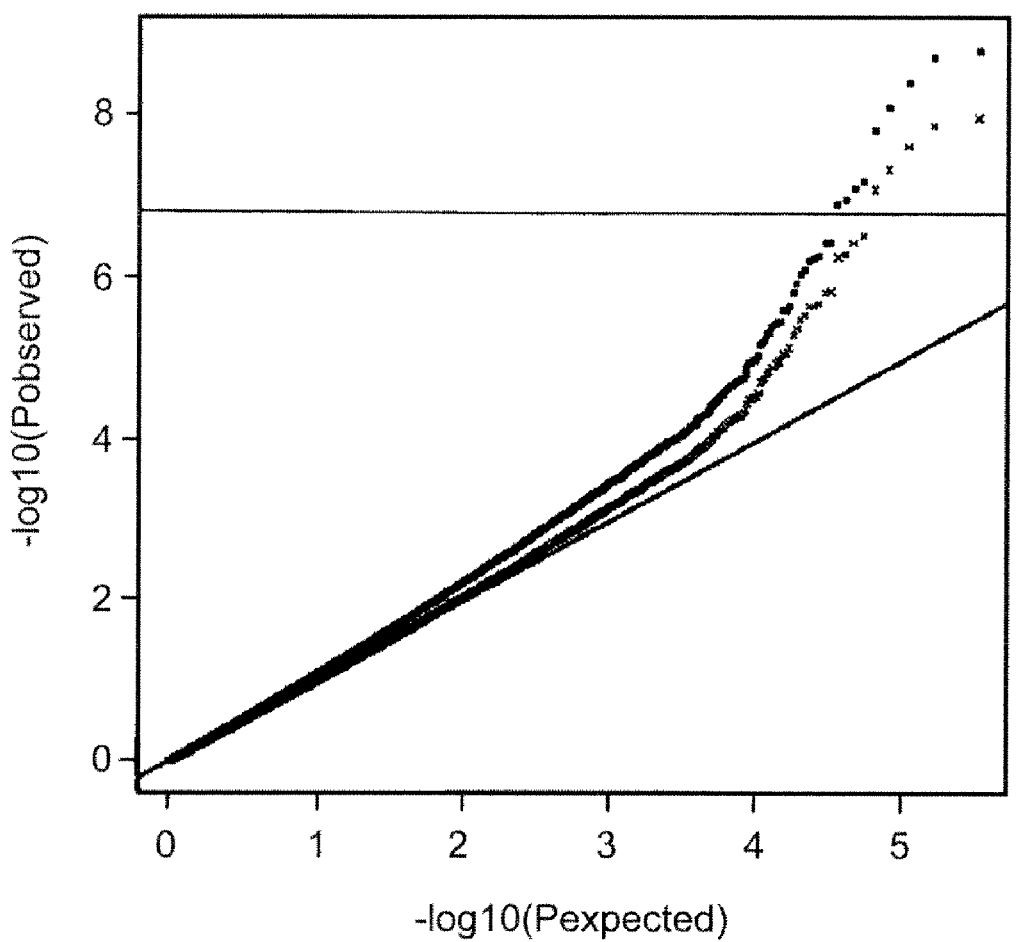
FIG. 2 represents a quantile-quantile (QQ) plot of 312,719 SNPs in the genome-wide association scan for blood eosinophil counts. The horizontal line represents the threshold for genome-wide significance. The top diagonal line represents observations and the middle diagonal line represents the same data scaled down by an inflation factor of 1.11. The bottom diagonal line represents where the dots are expected to fall under the null hypothesis of no association.

9,392 of these were genotyped using the Illumina 317K set of single nucleotide polymorphisms (SNPs) (Illumina, San Diego, Calif.). After quality control, 312,179 SNPs remained (FIG. 2). The top 55 SNPs from the Icelandic genome-wide eosinophil association scan are shown in Table 3.

TABLE 3

| SNP/Allele | Chr | Position[a] | Name of Gene Associated with SNP | Entrez Gene ID No. | Iceland Discovery (N = 9,392) | |
|---|---|---|---|---|---|---|
| | | | | | Effect[b] | P value[c] |
| rs11679137 G | 2 | 30,333,531 | LBH | 81606 | 5.5 | $7.9 \cdot 10^{-5}$ |
| rs1370631 A | 2 | 78,263,516 | | | 8.1 | $1.1 \cdot 10^{-5}$ |
| rs2164850 C | 2 | 78,277,265 | | | 8.4 | $4.0 \cdot 10^{-6}$ |
| rs4851400 A | 2 | 101,063,081 | TBC1D8 | 11138 | 7.0 | $1.9 \cdot 10^{-5}$ |
| rs2165427 A | 2 | 101,097,567 | TBC1D8 | 11138 | 7.2 | $1.0 \cdot 10^{-5}$ |
| rs4851411 T | 2 | 101,168,510 | | | 5.9 | $2.0 \cdot 10^{-5}$ |
| rs1420101 A | 2 | 102,324,148 | IL1RL1 | 9173 | 6.4 | $5.9 \cdot 10^{-7}$ |
| rs12998521 T | 2 | 102,340,849 | | | 5.6 | $1.1 \cdot 10^{-5}$ |
| rs1559930 A | 2 | 204,709,808 | | | 5.1 | $7.8 \cdot 10^{-5}$ |
| rs6730424 T | 2 | 204,739,314 | | | 5.9 | $2.9 \cdot 10^{-5}$ |
| rs12619285 A | 2 | 213,532,290 | | | 6.8 | $1.5 \cdot 10^{-6}$ |
| rs6439132 T | 3 | 129,732,825 | | | 6.2 | $2.7 \cdot 10^{-5}$ |
| rs4857855 C | 3 | 129,743,240 | | | 8.3 | $3.7 \cdot 10^{-7}$ |
| rs7635061 A | 3 | 129,755,171 | | | 7.2 | $5.3 \cdot 10^{-7}$ |
| rs2335050 C | 3 | 129,761,493 | | | 7.9 | $9.0 \cdot 10^{-7}$ |
| rs2532072 C | 4 | 15,511,238 | | | 7.0 | $2.2 \cdot 10^{-5}$ |
| rs4629469 G | 4 | 36,095,442 | | | 5.2 | $4.7 \cdot 10^{-5}$ |
| rs2416257 G | 5 | 110,463,389 | WDR36 | 134430 | 7.9 | $8.9 \cdot 10^{-6}$ |
| rs184941 G | 5 | 110,567,791 | | | 7.2 | $6.0 \cdot 10^{-7}$ |
| rs11950562 A | 5 | 131,680,428 | SLC22A4 | 6583 | 5.3 | $2.1 \cdot 10^{-5}$ |
| rs272893 A | 5 | 131,690,961 | SLC22A4 | 6583 | 5.9 | $4.9 \cdot 10^{-6}$ |
| rs1050152 C | 5 | 131,704,219 | SLC22A4 | 6583 | 5.9 | $3.4 \cdot 10^{-6}$ |
| rs2188962 C | 5 | 131,798,704 | LOC441108 | 441108 | 6.2 | $1.2 \cdot 10^{-6}$ |
| rs4143832 A | 5 | 131,890,876 | | | 10.0 | $8.0 \cdot 10^{-9}$ |
| rs2079103 T | 5 | 131,892,405 | | | 8.6 | $1.5 \cdot 10^{-8}$ |
| rs2244012 C | 5 | 131,929,124 | RAD50 | 10111 | 9.0 | $6.6 \cdot 10^{-8}$ |
| rs2897443 A | 5 | 131,957,493 | RAD50 | 10111 | 8.8 | $1.3 \cdot 10^{-7}$ |
| rs6871536 C | 5 | 131,997,773 | RAD50 | 10111 | 8.9 | $8.0 \cdot 10^{-8}$ |
| rs2269426 T | 6 | 32,184,477 | TNXB | 7148 | 6.0 | $6.4 \cdot 10^{-6}$ |
| rs9494145 T | 6 | 135,474,245 | | | 7.4 | $3.8 \cdot 10^{-7}$ |
| rs273148 G | 7 | 41,478,264 | | | 5.5 | $1.9 \cdot 10^{-5}$ |
| rs748065 A | 8 | 21,734,049 | | | 6.0 | $1.0 \cdot 10^{-5}$ |
| rs11778166 C | 8 | 22,985,295 | | | 6.9 | $1.1 \cdot 10^{-7}$ |
| rs1412426 T | 9 | 6,178,652 | | | 6.0 | $5.8 \cdot 10^{-6}$ |
| rs992969 A | 9 | 6,199,697 | | | 6.8 | $2.6 \cdot 10^{-6}$ |
| rs3939286 A | 9 | 6,200,099 | IL-33 | | 6.8 | $2.5 \cdot 10^{-6}$ |
| rs2663041 T | 10 | 49,777,543 | WDFY4 | 57705 | 5.7 | $6.1 \cdot 10^{-6}$ |
| rs12411706 G | 10 | 93,590,282 | TNKS2 | 80351 | 7.7 | $2.4 \cdot 10^{-5}$ |
| rs1265566 T | 12 | 110,200,759 | CUX2 | 23316 | 6.3 | $2.2 \cdot 10^{-6}$ |
| rs3184504 T | 12 | 110,368,991 | SH2B3 | 10019 | 7.7 | $2.0 \cdot 10^{-9}$ |
| rs653178 G | 12 | 110,492,139 | ATXN2 | 6311 | 7.7 | $1.6 \cdot 10^{-9}$ |
| rs11066320 A | 12 | 111,390,798 | PTPN11 | 5781 | 7.7 | $3.8 \cdot 10^{-9}$ |
| rs233722 C | 12 | 111,515,857 | | | 6.2 | $3.6 \cdot 10^{-6}$ |
| rs233716 G | 12 | 111,524,326 | | | 5.7 | $1.9 \cdot 10^{-5}$ |
| rs7315519 A | 12 | 111,677,310 | | | 5.9 | $3.4 \cdot 10^{-6}$ |
| rs4773225 G | 13 | 110,043,093 | | | 5.2 | $3.0 \cdot 10^{-5}$ |
| rs7150454 G | 14 | 67,835,411 | RAD51L1 | 5890 | 7.0 | $4.7 \cdot 10^{-6}$ |
| rs927220 C | 14 | 67,837,725 | RAD51L1 | 5890 | 5.8 | $1.7 \cdot 10^{-5}$ |
| rs6503609 A | 17 | 36,596,245 | | | 5.5 | $1.2 \cdot 10^{-5}$ |
| rs7223150 G | 17 | 51,013,132 | | | 6.2 | $3.3 \cdot 10^{-5}$ |
| rs9954643* G | 18 | 25,127,511 | | | 8.4 | $6.1 \cdot 10^{-5}$ |

TABLE 3-continued

| SNP/Allele | Chr | Position[a] | Name of Gene Associated with SNP | Entrez Gene ID No. | Iceland Discovery (N = 9,392) | |
|---|---|---|---|---|---|---|
| | | | | | Effect[b] | P value[c] |
| rs231228 C | 19 | 40,960,611 | SNX26 | 115703 | 6.3 | $1.5 \cdot 10^{-5}$ |
| rs1805419 G | 19 | 54,150,916 | BAX | 581 | 6.9 | $7.9 \cdot 10^{-7}$ |
| rs1467412 A | 20 | 49,678,608 | ATP9A | 10079 | 5.3 | $2.2 \cdot 10^{-5}$ |
| rs2426358 C | 20 | 49,711,704 | ATP9A | 10079 | 5.7 | $1.0 \cdot 10^{-5}$ |

[a]Position in build 36 coordinates.
[b]Effect in percentage standard units.
[c]Corrected using a genome-wide inflation factor of 1.10.
*rs9954643 is also known as rs12456181

4,458 more Icelanders were analyzed as a follow-up (replication) set to validate the 36 SNPs having the highest signal identified in the discovery step. Blood eosinophils of Icelanders in the follow-up (replication) set were counted at the same laboratory as for the ones in the discovery set, for an average of 1.8 counts per individual.

Figure 3:
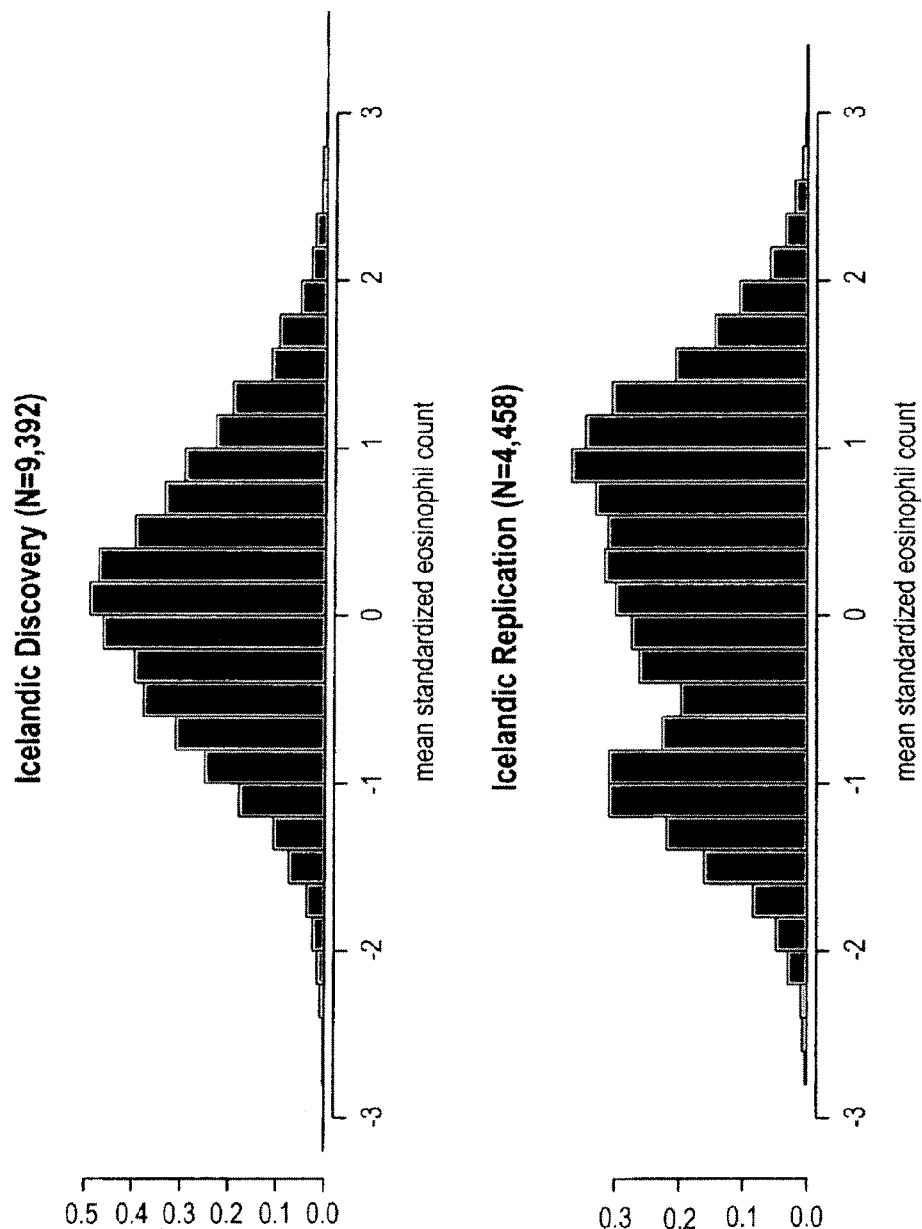
FIG. 3 represents a distribution of mean standardized eosinophil counts in the Icelandic Discovery and Replication samples.
Figure 4B:
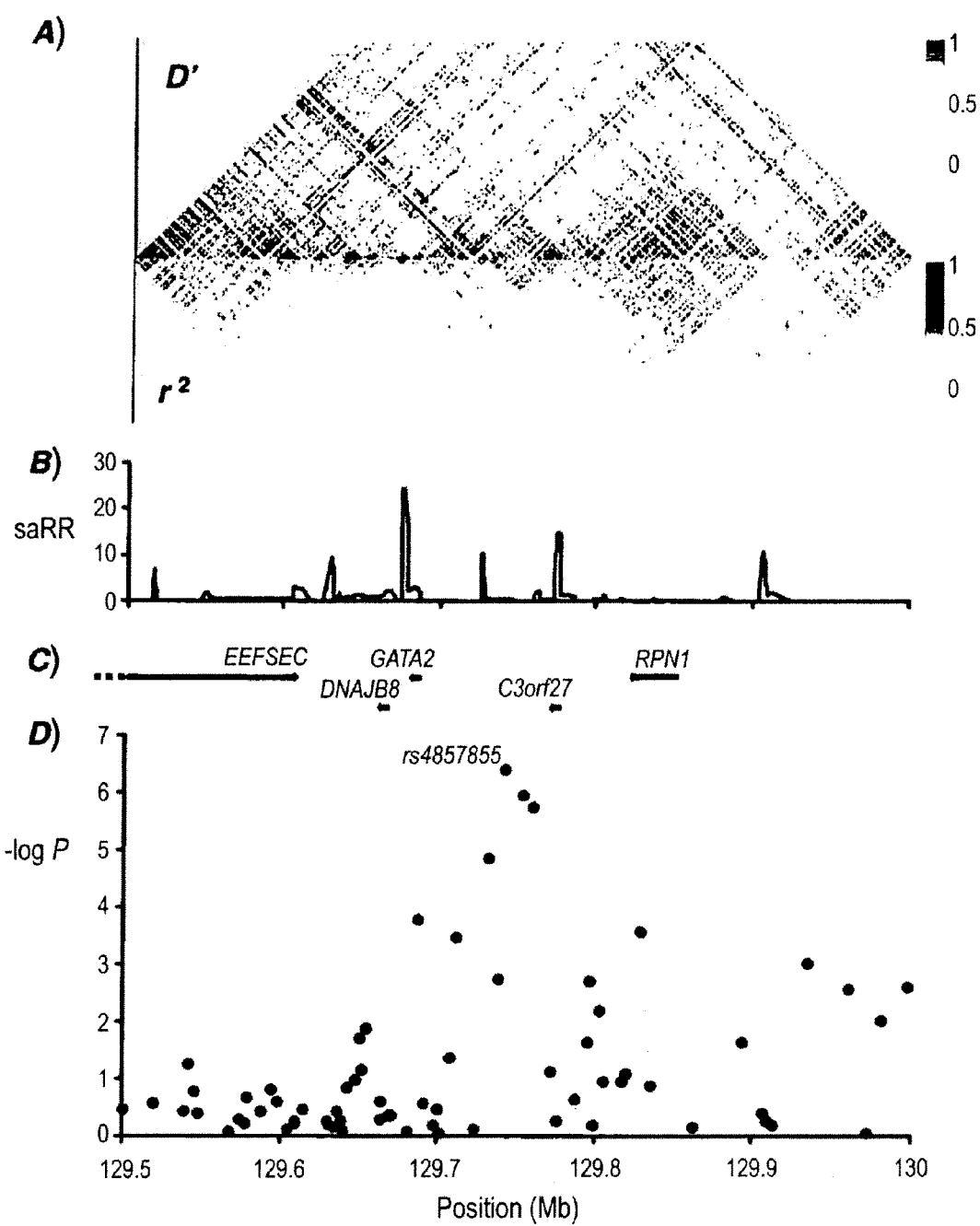
Figure 4D:
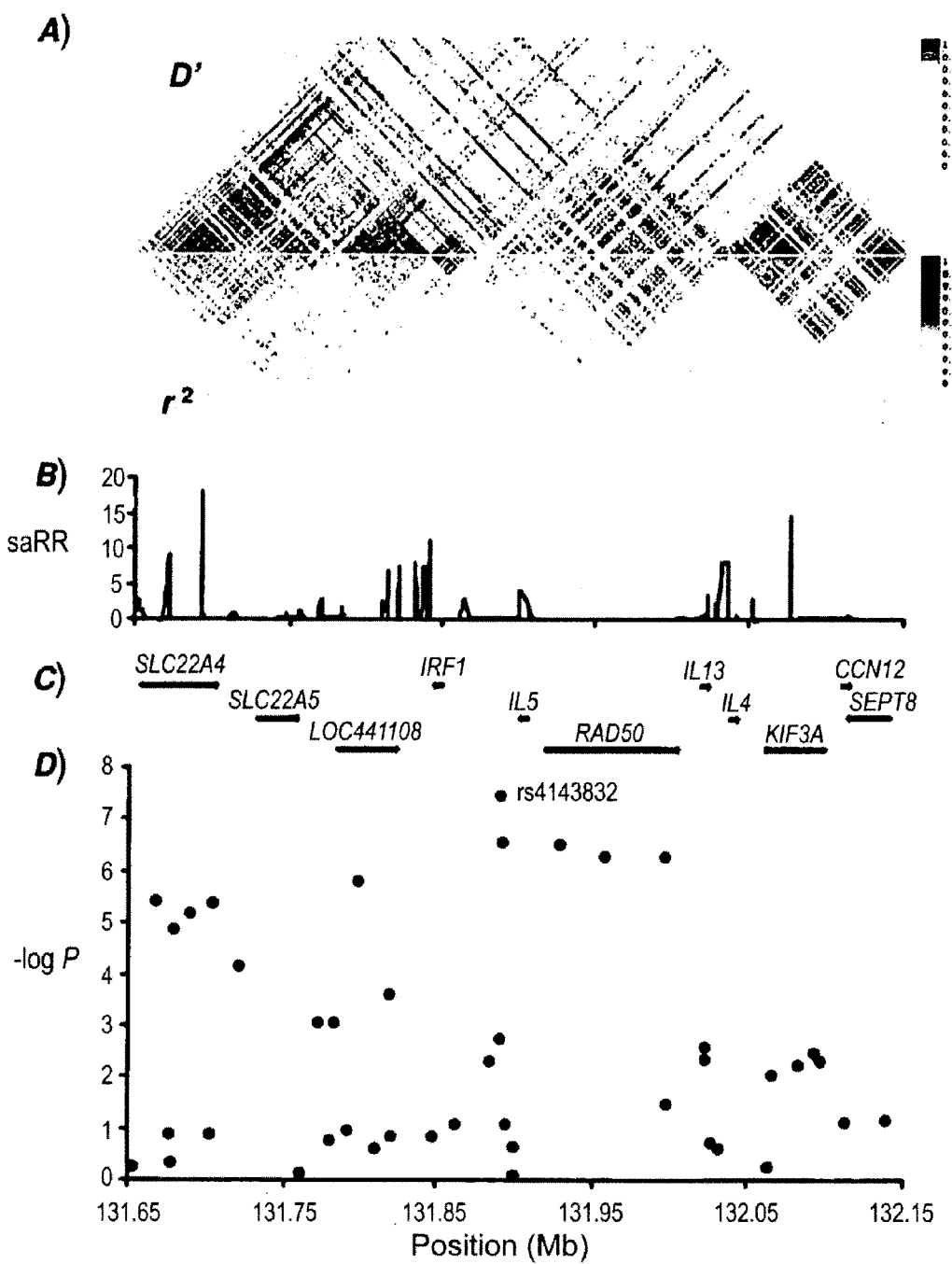
Figure 4E:
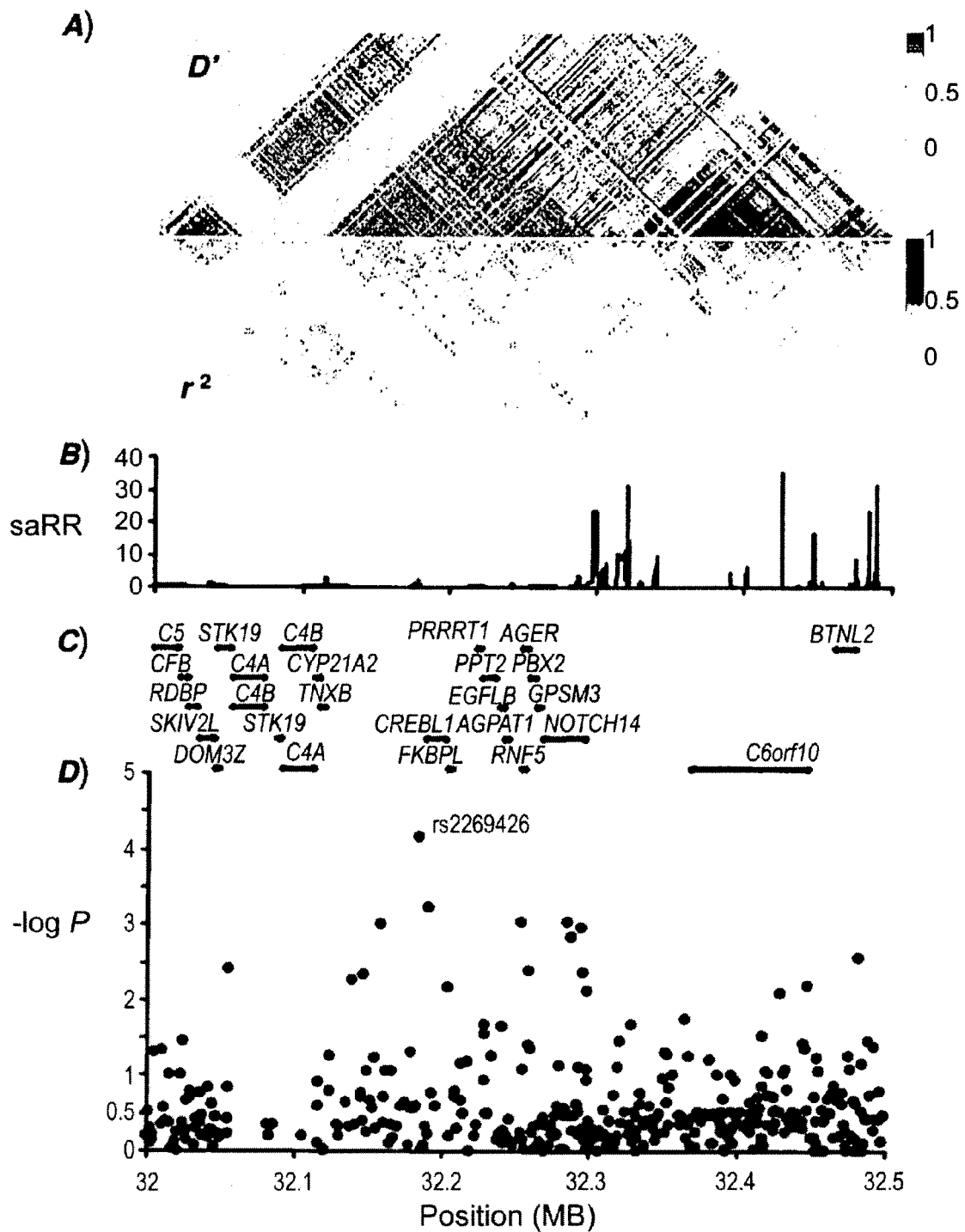
Figure 4F:
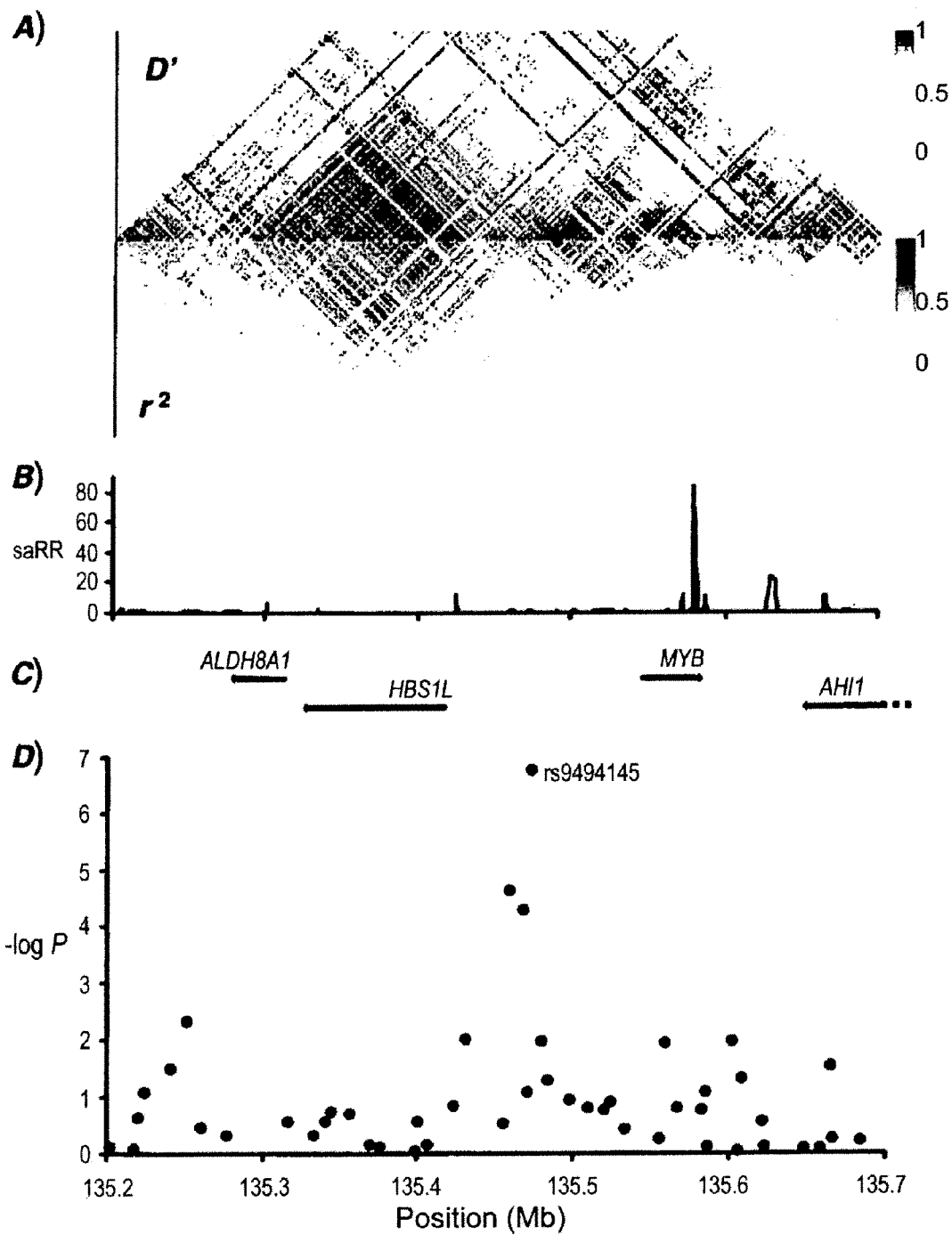
Figure 4I:
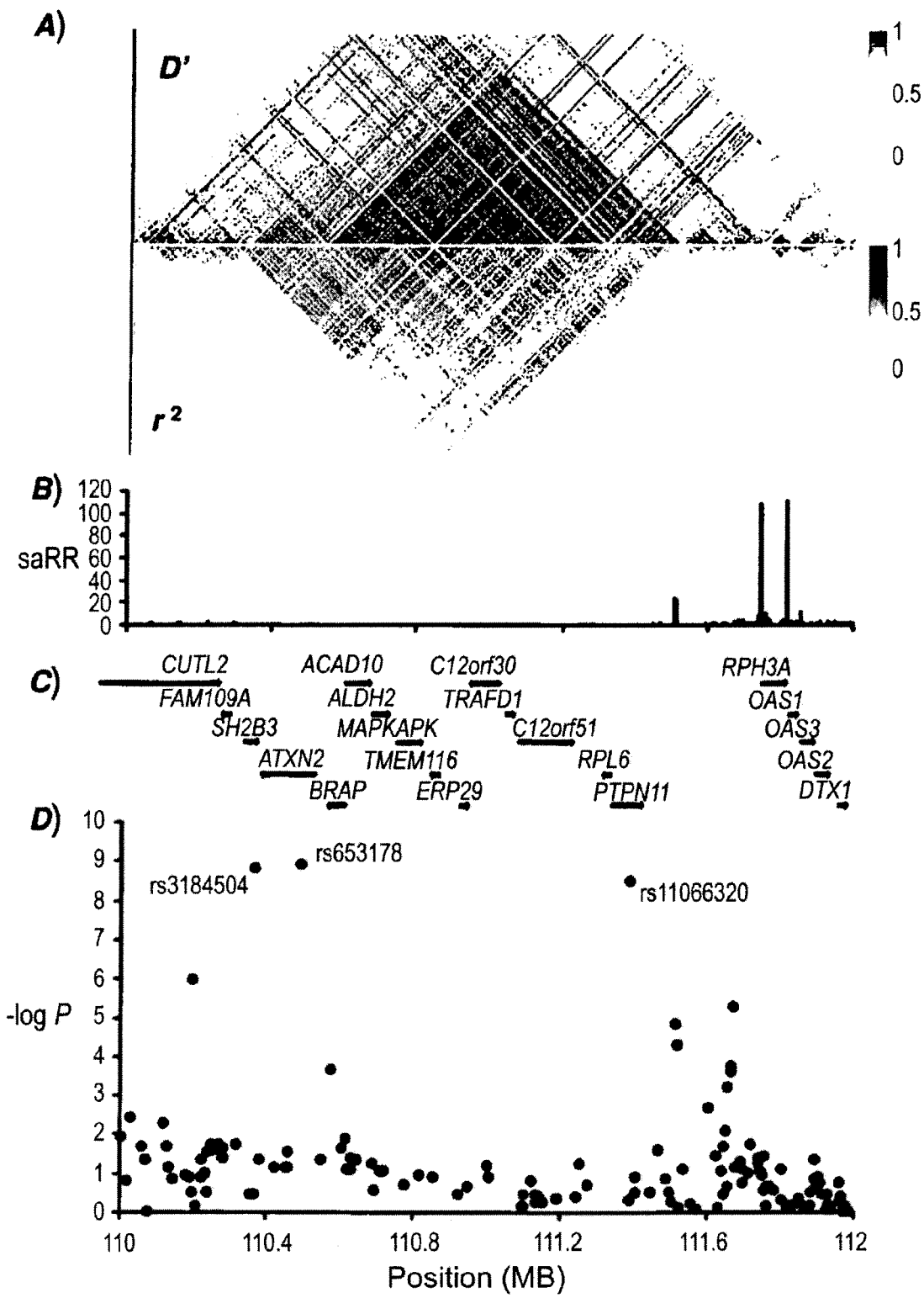

The replication sample was selected to have more extreme eosinophil values than the normal population (FIG. 3) and its variance was 1.40 times greater than for the overall measured populations. Selecting extreme valued individuals for genotyping is known to inflate effect estimates. If effect sizes are small (as is the case in the present application), then selecting individuals with absolute values above a certain threshold will inflate effect estimates by approximately the same amount as the variance in the inflated sample is inflated. All effect estimates were therefore deflated in the replication sample by a factor of 1.40.

Single SNP genotyping assays could be created for 32 out of the 36 selected SNPs. Two of the failing SNP assays had a good surrogate in the set of 32 functioning SNP assays. The results of the follow-up (replication) set are shown in Table 4.

TABLE 4

| SNP/Allele | Iceland Replication (N = 4,458) | | |
|---|---|---|---|
| | N | Effect[a] | P value[b] |
| rs11679137 G | 4,437 | −0.9 | 0.71 |
| rs2164850 C | 4,437 | 3.1 | 0.33 |
| rs2165427 A | 4,422 | 3.4 | 0.23 |
| rs1420101 A | 4,378 | 14.8 | $8.5 \cdot 10^{-11}$ |
| rs6730424 T | 4,435 | 2.2 | 0.37 |
| rs12619285 A | 4,439 | 5.7 | 0.024 |
| rs4857855 C | 4,390 | 13.4 | $3.6 \cdot 10^{-6}$ |
| rs7635061 A | 4,441 | 9.4 | 0.00018 |
| rs2532072 C | 4,454 | −4.8 | 0.098 |
| rs4629469 G | 4,435 | −2.3 | 0.31 |
| rs2416257 G | 4,403 | 8.6 | 0.0070 |
| rs184941 G | 4,442 | 4.2 | 0.098 |
| rs4143832 A | 4,431 | 17.2 | $1.0 \cdot 10^{-8}$ |
| rs2079103 T | 4,414 | 12.9 | $1.2 \cdot 10^{-6}$ |
| rs2269426 T | 4,440 | 7.2 | 0.0023 |
| rs9494145 T | 4,400 | 9.3 | 0.00037 |
| rs273148 G | 4,308 | 2.3 | 0.32 |
| rs748065 A | 4,436 | 3.8 | 0.11 |
| rs11778166 C | 4,430 | 1.5 | 0.50 |
| rs1412426 T | 4,428 | 6.7 | 0.0040 |
| rs3939286 A | 4,361 | 3.9 | 0.13 |
| rs2663041 T | 4,426 | 3.2 | 0.15 |
| rs12411706 G | assay failed | | |
| rs3184504 T | 4,425 | 14.9 | $8.5 \cdot 10^{-11}$ |
| rs653178 G | 4,432 | 14.4 | $2.8 \cdot 10^{-10}$ |
| rs11066320 A | 4,379 | 12.7 | $4.8 \cdot 10^{-08}$ |
| rs233722 C | assay failed | | |
| rs233716 G | assay failed | | |
| rs4773225 G | 4,408 | 1.1 | 0.61 |
| rs7150454 G | 4,439 | 3.7 | 0.17 |
| rs6503609 A | 4,393 | −0.9 | 0.69 |
| rs7223150 G | 4,436 | 0.2 | 0.93 |
| rs9954643 G | 3,932 | 0.8 | 0.77 |
| rs231228 C | 4,433 | −0.5 | 0.86 |
| rs1805419 G | assay failed | | |
| rs2426358 C | 4,427 | 2.3 | 0.30 |

[a]Effect in percentage of standard units.
[b]Uncorrected P value.

Fifteen of the 32 tested SNPs at 10 distinct loci were chosen for further study in 1,411 individuals from the United States, 387 from Germany, 419 from Sweden and 484 from Italy. The effect of the SNPs correlating with blood eosinophil counts were also examined in a set of 5,212 East Asian individuals: 1,958 from the Korea and 3,254 from Hong Kong. An overview of the subjects (Mean M) of each of sample set with available circulating eosinophil numbers is shown in Table 5 and the results of the genome-wide search for SNPs associating with blood eosinophil count and the replication effort are shown in Tables 6 and 7.

TABLE 5

| Sample set | N | YOB/AGE (SEM) | Male % | Mean M |
|---|---|---|---|---|
| Iceland Discovery | 9,392 | 1943 (18) | 36% | 2.2 |
| Iceland Replication | 4,458 | 1950 (17) | 40% | 1.8 |
| Iceland not genotyped | 25,205 | 1957 (19) | 40% | 1.6 |
| Germany II | 387 | 40 (6) | 51% | 1 |
| US, Durham | 1,411 | 1943 (12) | 62% | 1 |
| Sweden | 462 | 34 (7) | 64% | 1 |
| Verona, Italy | 484 | 58 (11) | 82% | 1 |
| Korea | 1,958 | 1957 (16) | 40% | 1 |
| Hong Kong | 3,254 | 54 (14) | 48% | 1 |

N, the number of subjects;
YOB/AGE, the mean year of birth or age;
SEM, standard error of the mean;
Male %, the fraction of male individuals;
GM M, the geometric mean number of times eosinophils were counted for each subject.

TABLE 6

| SNP/Allele | Chr | Position | Freq$^a$ | Gene | Iceland Discovery (N = 9,392) | | Iceland Replication (N = 4,458) | |
|---|---|---|---|---|---|---|---|---|
| | | | | | Effect | P value | Effect$^b$ | P value |
| SNPs satisfying the criteria for genome-wide significance | | | | | | | | |
| rs1420101 A$^c$ | 2 | 102,324,148 | 41 | IL1RL1 | 6.4 | $2.2 \cdot 10^{-6}$ | 11.0 | $8.5 \cdot 10^{-11}$ |
| rs12619285 G | 2 | 213,532,290 | 74 | IKZF2 | 6.8 | $5.1 \cdot 10^{-6}$ | 4.2 | 0.024 |
| rs4857855 T | 3 | 129,743,240 | 82 | GATA2 | 8.3 | $1.5 \cdot 10^{-6}$ | 9.9 | $3.6 \cdot 10^{-6}$ |
| rs4143832 C | 5 | 131,890,876 | 16 | IL5 | 10.0 | $4.6 \cdot 10^{-8}$ | 12.8 | $1.0 \cdot 10^{-8}$ |
| rs9494145 T | 6 | 135,474,245 | 33 | MYB | 7.4 | $1.5 \cdot 10^{-6}$ | 6.9 | 0.00037 |
| rs3184504 T | 12 | 110,368,991 | 38 | SH2B3 | 7.7 | $1.3 \cdot 10^{-8}$ | 11.1 | $8.5 \cdot 10^{-11}$ |
| SNPs that did not satisfy the criteria for genome-wide significance | | | | | | | | |
| rs2416257 G | 5 | 110,463,389 | 85 | WDR36 | 7.9 | $2.5 \cdot 10^{-5}$ | 6.4 | 0.0070 |
| rs2269426 T | 6 | 32,184,477 | 76 | MHC | 6.0 | $1.9 \cdot 10^{-5}$ | 5.3 | 0.0023 |
| rs748065 A | 8 | 21,734,049 | 69 | GFRA2 | 6.0 | $2.9 \cdot 10^{-5}$ | 2.8 | 0.11 |
| rs3939286 A | 9 | 6,200,099 | 25 | IL33 | 6.8 | $8.2 \cdot 10^{-6}$ | 2.9 | 0.13 |

| SNP/Allele | Other European (N = 2,701) | | Combined European (N = 16,551) | | East Asian (N = 5,212) | | |
|---|---|---|---|---|---|---|---|
| | Effect | P value | Effect (95% CI) | P value | Freq | Effect | P value |
| SNPs satisfying the criteria for genome-wide significance | | | | | | | |
| rs1420101 A$^c$ | 5.0 | 0.068 | 7.3 (5.4, 9.2) | $7.8 \cdot 10^{-14}$ | 37 | 4.7 | 0.051 |
| rs12619285 G | 6.7 | 0.023 | 6.1 (3.8, 8.3) | $1.2 \cdot 10^{-7}$ | 36 | 5.9 | 0.017 |
| rs4857855 T | 12.7 | 0.00031 | 9.4 (6.9, 11.9) | $2.0 \cdot 10^{-13}$ | 70 | 8.5 | 0.0017 |
| rs4143832 C | 2.3 | 0.50 | 9.0 (6.5, 11.5) | $2.7 \cdot 10^{-12}$ | 17 | 10.2 | 0.0039 |
| rs9494145 T | 0.5 | 0.87 | 6.1 (3.8, 8.3) | $1.0 \cdot 10^{-7}$ | 70 | 2.9 | 0.34 |
| rs3184504 T | 10.1 | 0.00013 | 8.8 (6.8, 10.7) | $6.6 \cdot 10^{-19}$ | 0$^d$ | | |
| SNPs that did not satisfy the criteria for genome-wide significance | | | | | | | |
| rs2416257 G | 4.7 | 0.23 | 6.8 (4.0, 9.6) | $1.8 \cdot 10^{-6}$ | 95 | −0.8 | 0.87 |
| rs2269426 T | 1.1 | 0.68 | 4.9 (2.9, 7.0) | $2.2 \cdot 10^{-6}$ | 30 | −0.4 | 0.89 |
| rs748065 A | 2.2 | 0.44 | 4.5 (2.3, 6.7) | $4.9 \cdot 10^{-5}$ | 43 | −0.5 | 0.84 |
| rs3939286 A | 3.9 | 0.21 | 5.3 (2.9, 7.7) | $1.1 \cdot 10^{-5}$ | 3 | −5.5 | 0.55 |

Results of genome-wide search for SNPs associating with blood eosinophil count and replication effort. Effects are given in percentage of standard units.
$^a$Frequency in Iceland.
$^b$Because of the extreme value selection in the Icelandic replication, the corresponding estimates have been deflated by a factor of 1.40.
$^c$Because of assay quality issues, the reported results for the non-Icelandic samples are based on the T allele of rs950880 ($R^2 = 0.96$ in the CEU HapMap samples).
$^d$The frequency of the rs3184504 too low in the East Asians for our SNP assay to yield reliable genotypes.

TABLE 7

| SNP/Allele | Chr | Position | Freq$^a$ | Gene | Iceland Discovery (N = 9,392) | | Iceland Replication (N = 4,458) | |
|---|---|---|---|---|---|---|---|---|
| | | | | | Effect$^b$ | P value | Effect$^b$ | P value |
| rs7635061 G | 3 | 129,755,171 | 75 | GATA2 | 7.2 | $2.0 \cdot 10^{-6}$ | 9.4 | 0.00018 |
| rs184941 G | 5 | 110,463,389 | 85 | WDR36 | 7.2 | $2.3 \cdot 10^{-6}$ | 4.2 | 0.098 |
| rs2079103 T | 5 | 131,892,405 | 21 | IL5 | 8.6 | $8.2 \cdot 10^{-6}$ | 12.9 | $1.2 \cdot 10^{-6}$ |
| rs1412426 T | 9 | 6,178,652 | 33 | IL33 | 6.0 | $1.7 \cdot 10^{-5}$ | 6.7 | 0.0040 |
| rs653178 G | 12 | 110,492,139 | 39 | SH2B3 | 7.7 | $1.1 \cdot 10^{-8}$ | 14.4 | $2.8 \cdot 10^{-9}$ |

| SNP/Allele | Other European (N = 2,701) | | Combined European (N = 16,551) | | Korean (N = 5,212) | | |
|---|---|---|---|---|---|---|---|
| | Effect$^b$ | P value | Effect$^b$ (95% CI) | P value | Freq | Effect$^b$ | P value |
| rs7635061 G | 11.1 | 0.00011 | 8.5 (6.1, 10.9) | $4.1 \cdot 10^{-12}$ | 58 | 6.3 | 0.0076 |
| rs184941 G | −0.1 | 0.98 | 5.2 (2.7, 7.6) | $3.5 \cdot 10^{-5}$ | 87 | −3.6 | 0.20 |
| rs2079103 T | −0.3 | 0.93 | 7.9 (5.3, 10.4) | $1.2 \cdot 10^{-9}$ | 35 | 3.4 | 0.16 |

TABLE 7-continued

| | | | | | | | |
|---|---|---|---|---|---|---|---|
| rs1412426 T | −1.6 | 0.56 | 4.9 (2.7, 7.1) | $1.8 \cdot 10^{-5}$ | 5 | −2.0 | 0.69 |
| rs653178 G | 9.8 | 0.00020 | 9.7 (7.5, 11.9) | $2.1 \cdot 10^{-8}$ | 0[c] | | |

Effects are given in percentage of standard units.
[a]Frequency in Iceland.
[b]Effect in percentage of standard units.
[c]The frequency of the chromosome 12 SNPs is too low in the Koreans for our SNP assay to yield reliable genotypes.

As shown in Tables 4 and 5, combining the results from the discovery and follow-up sets variants at six out of ten loci satisfied our criteria for genome-wide significance ($P<1.6\cdot10^{-7}\approx0.05/312.179$) and had a consistent direction of correlation between the sample sets. SNPs at four out of the ten loci replicated nominally in the East Asians and the SNPs at three out of the remaining six loci had minor allele frequency less than 5%, leading to little replication power.

Risk (odds ratio, OR) was calculated for the SNPs of Table 4 by comparing the top 5% of the eosionophil count distribution to the lowest 5%. Also, risk for genotyped surrogates with r2>0.2 to the anchor marker were determined. The calculated risk for the anchor marker and surrogate markers are shown in Table 8.

TABLE 8

| SNP in LD with Anchor SNP | Allele | $r^2$ | Anchor SNP | Chr | Position | qtl p-value | qtl_effect | 5pct p-value | 5pc OR |
|---|---|---|---|---|---|---|---|---|---|
| rs12475055 | 2 | 0.239147 | rs1420101 | C02 | 102245323 | 7.49E−05 | 0.049484 | 0.0181384 | 1.25137 |
| rs4399750 | 2 | 0.645931 | rs1420101 | C02 | 102284220 | 0.004981 | 0.035528 | 0.123172 | 1.157533 |
| rs11685424 | 1 | 0.587682 | rs1420101 | C02 | 102293413 | 0.004254 | 0.036156 | 0.11363 | 1.161918 |
| rs1420101 | 1 | 1 | rs1420101 | C02 | 102324148 | 5.87E−07 | 0.064069 | 0.00678028 | 1.30132 |
| rs1921622 | 1 | 0.39006 | rs1420101 | C02 | 102332499 | 0.00043 | 0.044981 | 0.351245 | 1.093278 |
| rs10204137 | 1 | 0.297189 | rs1420101 | C02 | 102334644 | 6.63E−05 | 0.050735 | 0.0194379 | 1.254094 |
| rs10192157 | 2 | 0.297189 | rs1420101 | C02 | 102334788 | 6.77E−05 | 0.050716 | 0.0218273 | 1.248735 |
| rs10206753 | 4 | 0.297189 | rs1420101 | C02 | 102334794 | 6.17E−05 | 0.050949 | 0.0194379 | 1.25409 |
| rs12998521 | 4 | 0.798263 | rs1420101 | C02 | 102340849 | 1.07E−05 | 0.056065 | 0.0226378 | 1.24675 |
| rs1035130 | 1 | 0.850885 | rs1420101 | C02 | 102367834 | 2.76E−05 | 0.056171 | 0.0122381 | 1.291096 |
| rs4851004 | 2 | 0.241829 | rs1420101 | C02 | 102375969 | 0.000456 | 0.043819 | 0.0174058 | 1.253672 |
| rs2287033 | 1 | 0.241829 | rs1420101 | C02 | 102377669 | 0.000518 | 0.04338 | 0.0173021 | 1.25426 |
| rs1420094 | 3 | 0.241829 | rs1420101 | C02 | 102382119 | 0.00046 | 0.04379 | 0.018053 | 1.25196 |
| rs3755266 | 2 | 0.241829 | rs1420101 | C02 | 102409144 | 0.000306 | 0.04515 | 0.0151522 | 1.259726 |
| rs2310300 | 1 | 0.241829 | rs1420101 | C02 | 102415506 | 0.000349 | 0.044715 | 0.0161837 | 1.256869 |
| rs10490204 | 3 | 0.812829 | rs1420101 | C02 | 102422966 | 4.32E−05 | 0.054888 | 0.0342592 | 1.241005 |
| rs3771150 | 4 | 0.850885 | rs1420101 | C02 | 102427283 | 3.46E−05 | 0.055636 | 0.0275247 | 1.25229 |
| rs11465730 | 3 | 0.444093 | rs1420101 | C02 | 102433290 | 0.105871 | 0.020429 | 0.312456 | 1.10074 |
| rs975381 | 1 | 0.252874 | rs12619285 | C02 | 213524876 | 0.040956 | 0.02606 | 0.248138 | 1.118912 |
| rs12619285 | 1 | 1 | rs12619285 | C02 | 213532290 | 1.48E−06 | 0.068321 | 0.0192685 | 1.281924 |
| rs7577413 | 3 | 0.331897 | rs12619285 | C02 | 213564411 | 0.01136 | 0.031832 | 0.364715 | 1.08974 |
| rs4673714 | 3 | 0.219601 | rs12619285 | C02 | 213566402 | 0.041971 | 0.02565 | 0.390435 | 1.08655 |
| rs1871946 | 1 | 0.319792 | rs12619285 | C02 | 213587652 | 0.000226 | 0.047591 | 0.0922913 | 1.178591 |
| rs2335052 | 3 | 0.725275 | rs4857855 | C03 | 129687641 | 0.000164 | 0.06537 | 0.0232475 | 1.35443 |
| rs6439132 | 4 | 0.665622 | rs4857855 | C03 | 129732825 | 2.74E−05 | 0.061519 | 0.000345149 | 1.49797 |
| rs9854612 | 3 | 0.559229 | rs4857855 | C03 | 129739904 | 0.00045 | 0.083888 | 0.000937209 | 1.94754 |
| rs4857855 | 2 | 1 | rs4857855 | C03 | 129743240 | 3.70E−07 | 0.082629 | 0.00055014 | 1.538324 |
| rs7635061 | 1 | 0.403371 | rs4857855 | C03 | 129755171 | 5.35E−07 | 0.071823 | 0.000234859 | 1.503003 |
| rs2335050 | 2 | 0.733349 | rs4857855 | C03 | 129761493 | 8.98E−07 | 0.079172 | 0.000834332 | 1.513433 |
| rs6785206 | 3 | 0.251445 | rs4857855 | C03 | 129894714 | 0.03256 | 0.074033 | 0.111669 | 1.58835 |
| rs2416257 | 3 | 1 | rs2416257 | C05 | 110463389 | 8.86E−06 | 0.079062 | 0.018729 | 1.36234 |
| rs10051830 | 3 | 0.201183 | rs2416257 | C05 | 110480744 | 0.00251 | 0.038347 | 0.441189 | 1.0763 |
| rs1037684 | 4 | 0.441687 | rs2416257 | C05 | 110502060 | 0.000958 | 0.047365 | 0.0997369 | 1.19258 |
| rs390047 | 2 | 0.38914 | rs2416257 | C05 | 110502091 | 0.000285 | 0.051192 | 0.0390389 | 1.243458 |
| rs9326826 | 3 | 0.331984 | rs2416257 | C05 | 110522145 | 0.014129 | 0.033258 | 0.218605 | 1.13444 |
| rs1072056 | 3 | 0.423077 | rs2416257 | C05 | 110532014 | 0.018201 | 0.034008 | 0.276878 | 1.124786 |
| rs184941 | 3 | 0.405594 | rs2416257 | C05 | 110567791 | 6.04E−07 | 0.071615 | 0.0206139 | 1.29106 |
| rs1469441 | 3 | 0.581435 | rs2416257 | C05 | 110573038 | 0.001599 | 0.062255 | 0.0506812 | 1.34117 |
| rs919334 | 4 | 0.25641 | rs2416257 | C05 | 110581301 | 0.000579 | 0.044652 | 0.107527 | 1.17247 |
| rs273901 | 2 | 0.257589 | rs4143832 | C05 | 131722259 | 5.60E−05 | 0.053792 | 0.101138 | 1.17946 |
| rs1016988 | 2 | 0.356148 | rs4143832 | C05 | 131772473 | 0.000284 | 0.057209 | 0.148547 | 1.19418 |
| rs1003533 | 4 | 0.323815 | rs4143832 | C05 | 131783550 | 0.000514 | 0.054876 | 0.146702 | 1.19415 |
| rs4143832 | 1 | 1 | rs4143832 | C05 | 131890876 | 7.95E−09 | 0.099564 | 0.000650341 | 1.567517 |
| rs2079103 | 4 | 0.627184 | rs4143832 | C05 | 131892405 | 1.52E−08 | 0.086118 | 0.00147498 | 1.45091 |
| rs743562 | 4 | 0.260204 | rs4143832 | C05 | 131900282 | 0.290966 | 0.013573 | 0.0746446 | 1.18927 |
| rs2244012 | 2 | 0.429729 | rs4143832 | C05 | 131929124 | 6.56E−08 | 0.089869 | 0.00312604 | 1.456327 |
| rs2897443 | 1 | 0.429729 | rs4143832 | C05 | 131957493 | 1.27E−07 | 0.08847 | 0.00452021 | 1.439546 |
| rs6871536 | 2 | 0.429729 | rs4143832 | C05 | 131997773 | 7.98E−08 | 0.089217 | 0.003705 | 1.447097 |
| rs2844477 | 3 | 0.258205 | rs2269426 | C06 | 31686751 | 0.751533 | 0.007024 | 0.977307 | 1.00526 |
| rs2260000 | 2 | 0.258205 | rs2269426 | C06 | 31701455 | 0.007214 | 0.035499 | 0.104314 | 1.175543 |
| rs1077393 | 2 | 0.290127 | rs2269426 | C06 | 31718508 | 0.001985 | 0.038796 | 0.337422 | 1.095618 |
| rs1052486 | 2 | 0.279809 | rs2269426 | C06 | 31718665 | 0.002762 | 0.037552 | 0.38317 | 1.086829 |
| rs494620 | 1 | 0.214299 | rs2269426 | C06 | 31946692 | 0.695574 | 0.005026 | 0.657264 | 1.043966 |

TABLE 8-continued

| SNP in LD with Anchor SNP | Allele | r² | Anchor SNP | Chr | Position | qtl p-value | qtl_effect | 5pct p-value | 5pc OR |
|---|---|---|---|---|---|---|---|---|---|
| rs614549 | 4 | 0.244882 | rs2269426 | C06 | 31948604 | 0.377069 | 0.019471 | 0.901842 | 0.977895 |
| rs2736428 | 1 | 0.204766 | rs2269426 | C06 | 31951903 | 0.092212 | 0.02285 | 0.420892 | 1.085402 |
| rs2763982 | 3 | 0.218661 | rs2269426 | C06 | 31980530 | 0.917969 | 0.002262 | 0.891305 | 0.975592 |
| rs2734335 | 4 | 0.217984 | rs2269426 | C06 | 32001923 | 0.115164 | 0.019663 | 0.775684 | 1.02738 |
| rs537160 | 2 | 0.236625 | rs2269426 | C06 | 32024379 | 0.857659 | 0.003779 | 0.961881 | 0.991597 |
| rs4151657 | 2 | 0.233123 | rs2269426 | C06 | 32025519 | 0.014 | 0.034177 | 0.492992 | 1.07454 |
| rs2072633 | 2 | 0.276683 | rs2269426 | C06 | 32027557 | 0.126652 | 0.019057 | 0.191148 | 1.132188 |
| rs630379 | 3 | 0.244796 | rs2269426 | C06 | 32030233 | 0.03538 | 0.027705 | 0.483943 | 1.072763 |
| rs437179 | 3 | 0.240037 | rs2269426 | C06 | 32036993 | 0.038965 | 0.027035 | 0.507567 | 1.068524 |
| rs592229 | 4 | 0.382211 | rs2269426 | C06 | 32038420 | 0.350658 | 0.011601 | 0.780244 | 1.0269 |
| rs6941112 | 1 | 0.321092 | rs2269426 | C06 | 32054593 | 0.001038 | 0.046813 | 0.224357 | 1.139853 |
| rs389883 | 1 | 0.248944 | rs2269426 | C06 | 32055439 | 0.033111 | 0.027927 | 0.434377 | 1.081725 |
| rs12198173 | 1 | 0.203931 | rs2269426 | C06 | 32134786 | 0.19315 | 0.030749 | 0.0998665 | 1.350372 |
| rs2239689 | 4 | 0.277349 | rs2269426 | C06 | 32138262 | 0.001339 | 0.044466 | 0.107304 | 1.18271 |
| rs7766862 | 1 | 0.271353 | rs2269426 | C06 | 32140985 | 0.326675 | 0.022611 | 0.204373 | 1.268184 |
| rs2071295 | 1 | 0.303031 | rs2269426 | C06 | 32146678 | 0.001408 | 0.044264 | 0.113469 | 1.179278 |
| rs185819 | 2 | 0.582947 | rs2269426 | C06 | 32158045 | 0.000103 | 0.048646 | 0.00699072 | 1.291846 |
| rs2071293 | 4 | 0.303031 | rs2269426 | C06 | 32170665 | 0.354246 | 0.021534 | 0.276802 | 1.22892 |
| rs13199524 | 4 | 0.203931 | rs2269426 | C06 | 32174743 | 0.19315 | 0.030749 | 0.0998665 | 1.35037 |
| rs12153855 | 2 | 0.272544 | rs2269426 | C06 | 32182782 | 0.186337 | 0.029079 | 0.133139 | 1.284104 |
| rs2269426 | 4 | 1 | rs2269426 | C06 | 32184477 | 6.36E−06 | 0.060424 | 0.00224097 | 1.36308 |
| rs8111 | 1 | 0.560811 | rs2269426 | C06 | 32191153 | 0.000124 | 0.056517 | 0.0332117 | 1.268096 |
| rs9267803 | 4 | 0.560811 | rs2269426 | C06 | 32209740 | 0.080187 | 0.043081 | 0.186426 | 1.30003 |
| rs4713505 | 4 | 0.560811 | rs2269426 | C06 | 32212979 | 0.12762 | 0.036876 | 0.19102 | 1.2907 |
| rs1053924 | 3 | 0.364732 | rs2269426 | C06 | 32228693 | 0.023631 | 0.029171 | 0.66142 | 1.04409 |
| rs2269424 | 4 | 0.332172 | rs2269426 | C06 | 32240211 | 0.038244 | 0.052741 | 0.0587999 | 1.46981 |
| rs2269423 | 3 | 0.424223 | rs2269426 | C06 | 32253685 | 0.000866 | 0.041746 | 0.23546 | 1.119352 |
| rs1035798 | 4 | 0.332172 | rs2269426 | C06 | 32259200 | 0.003333 | 0.045356 | 0.17021 | 1.17417 |
| rs1800624 | 1 | 0.295681 | rs2269426 | C06 | 32260365 | 0.067244 | 0.046251 | 0.0930099 | 1.410734 |
| rs2071277 | 3 | 0.272032 | rs2269426 | C06 | 32279661 | 0.127458 | 0.019145 | 0.481086 | 1.07005 |
| rs9267833 | 2 | 0.290949 | rs2269426 | C06 | 32285878 | 0.000774 | 0.051018 | 0.0891845 | 1.21624 |
| rs2071286 | 1 | 0.26454 | rs2269426 | C06 | 32287874 | 0.001682 | 0.052094 | 0.122651 | 1.214475 |
| rs394657 | 3 | 0.260445 | rs2269426 | C06 | 32295001 | 0.002469 | 0.039145 | 0.101476 | 1.17534 |
| rs422951 | 3 | 0.234519 | rs2269426 | C06 | 32296361 | 0.011295 | 0.032556 | 0.332637 | 1.09962 |
| rs1547247 | 3 | 0.314304 | rs9494145 | C06 | 135432529 | 0.014643 | 0.033524 | 0.0610602 | 1.2122 |
| rs9399137 | 4 | 0.522581 | rs9494145 | C06 | 135460711 | 8.50E−05 | 0.055984 | 0.00468326 | 1.35603 |
| rs9376092 | 2 | 0.654676 | rs9494145 | C06 | 135468837 | 7.88E−05 | 0.054802 | 0.0127758 | 1.29938 |
| rs10484494 | 2 | 0.263158 | rs9494145 | C06 | 135471786 | 0.061091 | 0.067424 | 0.421827 | 1.228758 |
| rs9494145 | 4 | 1 | rs9494145 | C06 | 135474245 | 3.76E−07 | 0.074015 | 0.00222666 | 1.3988 |
| rs2026937 | 1 | 0.224511 | rs9494145 | C06 | 135480956 | 0.036028 | 0.026449 | 0.161419 | 1.142203 |
| rs12663543 | 1 | 0.280928 | rs9494145 | C06 | 135559307 | 0.006147 | 0.050495 | 0.178681 | 1.211381 |
| rs748065 | 1 | 1 | rs748065 | C08 | 21734049 | 1.01E−05 | 0.06047 | 0.0520788 | 1.22613 |
| rs922504 | 2 | 0.636364 | rs748065 | C08 | 21737990 | 0.000403 | 0.045145 | 0.0605276 | 1.200818 |
| rs10124250 | 4 | 0.503722 | rs3939286 | C09 | 6151686 | 0.001217 | 0.04104 | 0.580128 | 1.05506 |
| rs10119713 | 1 | 0.503722 | rs3939286 | C09 | 6153823 | 0.001034 | 0.04161 | 0.578224 | 1.055417 |
| rs2079 | 4 | 0.214206 | rs3939286 | C09 | 6156653 | 0.021313 | 0.030353 | 0.902469 | 1.01244 |
| rs2890704 | 4 | 0.252485 | rs3939286 | C09 | 6174165 | 0.031614 | 0.044502 | 0.233732 | 1.21539 |
| rs1412426 | 4 | 0.728507 | rs3939286 | C09 | 6178652 | 5.77E−06 | 0.060038 | 0.0594361 | 1.21116 |
| rs1342326 | 3 | 0.513678 | rs3939286 | C09 | 6180076 | 0.000472 | 0.06134 | 0.543933 | 1.082585 |
| rs992969 | 1 | 1 | rs3939286 | C09 | 6199697 | 2.57E−06 | 0.067837 | 0.122798 | 1.185049 |
| rs3939286 | 1 | 1 | rs3939286 | C09 | 6200099 | 2.53E−06 | 0.06785 | 0.117254 | 1.187938 |
| rs928413 | 3 | 1 | rs3939286 | C09 | 6203387 | 3.36E−05 | 0.05903 | 0.142429 | 1.17301 |
| rs2066362 | 4 | 0.399291 | rs3939286 | C09 | 6209176 | 0.004897 | 0.050724 | 0.500481 | 1.09477 |
| rs4766522 | 4 | 0.275346 | rs3184504 | C12 | 109877902 | 0.006323 | 0.034669 | 0.0517 | 1.20732 |
| rs4509829 | 2 | 0.275346 | rs3184504 | C12 | 109880996 | 0.006704 | 0.034346 | 0.0484383 | 1.210761 |
| rs991817 | 4 | 0.275346 | rs3184504 | C12 | 109894920 | 0.014281 | 0.031115 | 0.0911361 | 1.17795 |
| rs10774613 | 2 | 0.2646 | rs3184504 | C12 | 110030548 | 0.008063 | 0.034231 | 0.0526009 | 1.206557 |
| rs1265566 | 4 | 0.259762 | rs3184504 | C12 | 110200759 | 2.19E−06 | 0.063199 | 8.38E−05 | 1.49439 |
| rs7970490 | 1 | 0.221355 | rs3184504 | C12 | 110240821 | 0.019182 | 0.030961 | 0.0675107 | 1.203483 |
| rs3847953 | 3 | 0.263113 | rs3184504 | C12 | 110249847 | 0.01044 | 0.034102 | 0.137601 | 1.16355 |
| rs10774623 | 1 | 0.240386 | rs3184504 | C12 | 110317972 | 0.01452 | 0.03438 | 0.0139414 | 1.309524 |
| rs3184504 | 4 | 1 | rs3184504 | C12 | 110368991 | 1.95E−09 | 0.07701 | 2.95E−06 | 1.57496 |
| rs2301621 | 3 | 0.219935 | rs3184504 | C12 | 110379655 | 0.023694 | 0.031916 | 0.0270116 | 1.27651 |
| rs6490162 | 4 | 0.219935 | rs3184504 | C12 | 110425503 | 0.051138 | 0.027604 | 0.0493003 | 1.24371 |
| rs607316 | 3 | 0.200363 | rs3184504 | C12 | 110453831 | 0.041421 | 0.028939 | 0.0449431 | 1.24978 |
| rs616668 | 1 | 0.200363 | rs3184504 | C12 | 110458663 | 0.049987 | 0.027968 | 0.0578074 | 1.237559 |

TABLE 8-continued

| SNP in LD with Anchor SNP | Allele | $r^2$ | Anchor SNP | Chr | Position | qtl p-value | qtl_effect | 5pct p-value | 5pc OR |
|---|---|---|---|---|---|---|---|---|---|
| rs648997 | 3 | 0.370996 | rs3184504 | C12 | 110461159 | 0.034261 | 0.038832 | 0.114713 | 1.25933 |
| rs653178 | 3 | 1 | rs3184504 | C12 | 110492139 | 1.55E−09 | 0.077219 | 2.64E−06 | 1.57413 |
| rs601663 | 4 | 0.226059 | rs3184504 | C12 | 110607667 | 0.012877 | 0.032481 | 0.0906146 | 1.18587 |

Example 2

This example demonstrates whether the eosinophil loci were specific to eosinophils or had effect on more blood parameters.

Figure 5:
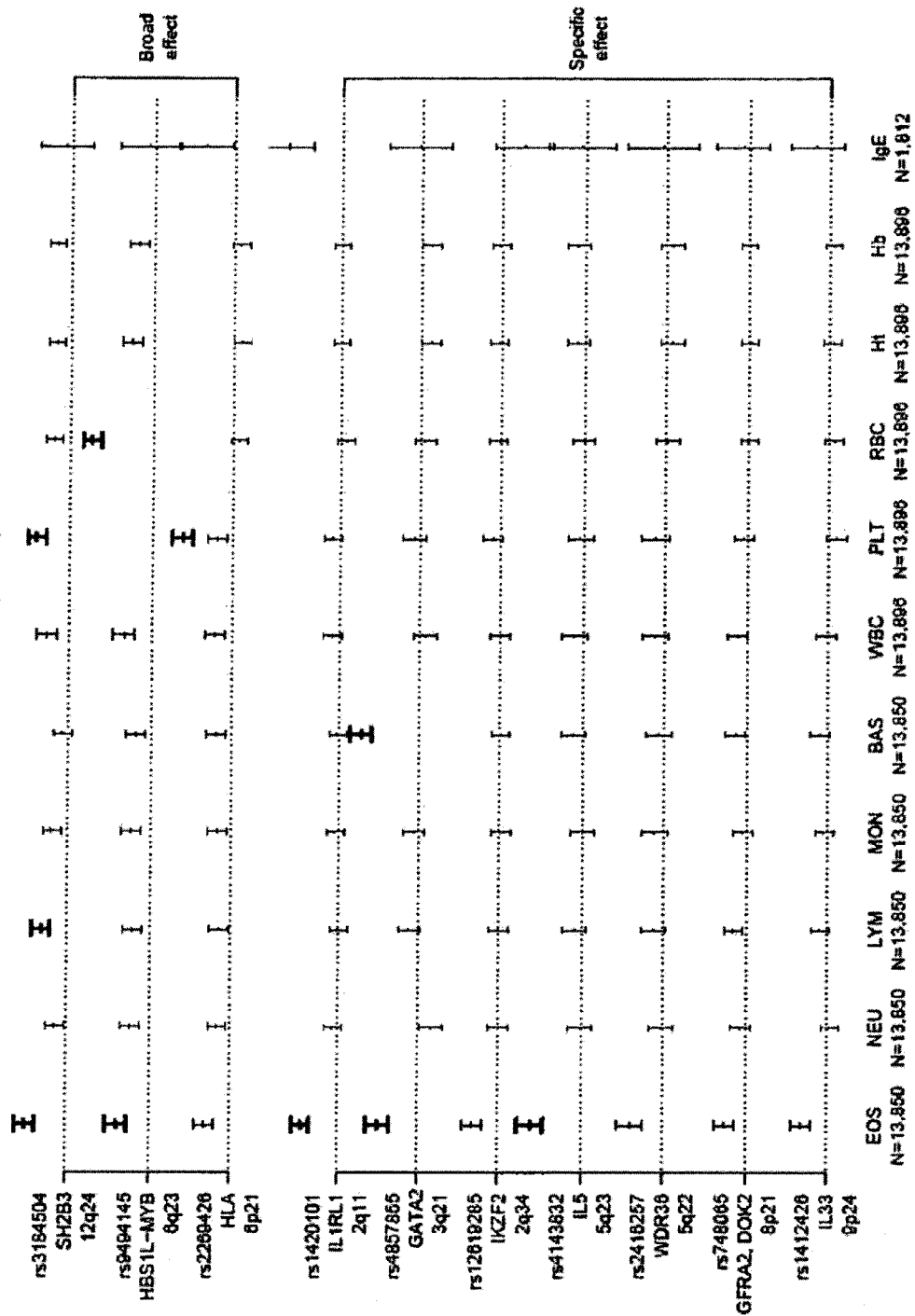
FIG. 5 represents the association of the SNPs, identified though the blood eosinophil count genome-wide scan, with differential white blood cell counts, platelet counts, and red blood. The SNPs are classified into having broad and narrow effects depending on the number of blood parameters with P<0.01. The middle tick shows the estimated effect and the end ticks mark its 95% confidence interval. The values behind this figure are given in Table 9. Association results with $P<10^{-7}$, $P<10^{-4}$, $P<0.01$, and $P>0.01$ are indicated by gradually thinning lines.

Data on white blood cell differential counts, platelet counts, and several red blood cell parameters were analyzed for the set of Icelanders having blood eosinophil counts. IgE measurements were also available for a smaller subset of individuals. FIG. 5 shows an overview of the association of the SNPs identified through the blood eosinophil count genome-wide scan with all these blood measurements. The results of the analysis is shown in Table 9.

those with effect limited to one or two blood parameters (FIG. 5).

Example 3

Given the role of eosinophils in the pathogenesis of asthma, the fifteen SNPs from the ten loci identified through the blood eosinophil count scan were tested for association with asthma and with its sub-phenotypes of atopic and non-atopic asthma in seven case control sample sets of European origin and one sample set of East Asian origin. Even though the association of SNPs at only six of the ten loci reached our threshold for genome-wide significance for association with eosinophil

TABLE 9

| | Eosinophils | | Neutrophils | | Lymphocytes | | Monocytes | | Basophiles | | WBC | |
|---|---|---|---|---|---|---|---|---|---|---|---|---|
| SNP | Eff.[a] | P | Eff.[a] | P | Eff.[a] | P | Eff.[a] | P | Eff.[a] | P | Eff.[a] | P |
| rs1420101 | 9.0 | $6.4 \times 10^{-14}$ | 1.2 | 0.27 | −0.2 | 0.83 | 0.7 | 0.53 | 0.2 | 0.88 | 1.8 | 0.13 |
| rs12619285 | 6.5 | $8.5 \times 10^{-7}$ | 0.3 | 0.81 | 0.2 | 0.90 | −0.2 | 0.89 | 0.0 | 1.0 | 0.2 | 0.85 |
| rs4857855 | 9.9 | $7.3 \times 10^{-11}$ | −3.4 | 0.016 | 2.3 | 0.11 | 1.2 | 0.41 | 14.5 | $1.8 \times 10^{-25}$ | −1.3 | 0.38 |
| rs4143832 | 12.3 | $1.9 \times 10^{-14}$ | 0.4 | 0.79 | 1.7 | 0.24 | −0.1 | 0.95 | 2.2 | 0.13 | 2.2 | 0.15 |
| rs2269426 | 6.4 | $3.5 \times 10^{-7}$ | 3.3 | $4.4 \times 10^{-3}$ | 2.9 | $1.2 \times 10^{-2}$ | 3.3 | $3.8 \times 10^{-3}$ | 3.8 | $7.3 \times 10^{-4}$ | 4.3 | $3.6 \times 10^{-4}$ |
| rs3184504 | 9.9 | $2.1 \times 10^{-16}$ | 2.9 | $8.3 \times 10^{-3}$ | 6.3 | $1.1 \times 10^{-8}$ | 3.7 | $7.3 \times 10^{-4}$ | 1.3 | 0.24 | 5.3 | $6.3 \times 10^{-6}$ |
| rs2416257 | 8.1 | $1.3 \times 10^{-6}$ | 0.6 | 0.69 | 2.5 | 0.10 | 2.4 | 0.12 | 1.4 | 0.37 | 2.3 | 0.16 |
| rs9494145 | 8.0 | $5 \times 10^{-9}$ | 4.7 | $1.7 \times 10^{-4}$ | 4.3 | $6.4 \times 10^{-4}$ | 4.8 | $1.3 \times 10^{-4}$ | 3.5 | $5.3 \times 10^{-3}$ | 6.8 | $3.8 \times 10^{-7}$ |
| rs748065 | 5.3 | $3.2 \times 10^{-5}$ | 1.3 | 0.27 | 3.0 | $9.8 \times 10^{-3}$ | 0.7 | 0.55 | 2.8 | $1.5 \times 10^{-2}$ | 2.1 | 0.097 |
| rs3939286 | 5.9 | $1.2 \times 10^{-5}$ | −1.9 | 0.13 | 0.9 | 0.46 | −0.6 | 0.63 | 1.6 | 0.21 | −0.5 | 0.73 |

| | Platelets | | RBC | | Hematocrit | | Hemoglobin | | IgE | |
|---|---|---|---|---|---|---|---|---|---|---|
| SNP | Eff.[a] | P | Eff.[a] | P | Eff.[a] | P | Eff.[a] | P | Eff.[a] | P |
| rs1420101 | 1.6 | 0.18 | −1.4 | 0.17 | 0.0 | 0.99 | 0.0 | 0.99 | 13.2 | $3.2 \times 10^{-5}$ |
| rs12619285 | 2.2 | $8.8 \times 10^{-2}$ | 0.9 | 0.43 | 0.8 | 0.47 | 0.5 | 0.66 | −5.0 | 0.16 |
| rs4857855 | 1.6 | 0.29 | −1.2 | 0.38 | −2.5 | $5.1 \times 10^{-2}$ | −2.3 | 0.066 | 0.6 | 0.87 |
| rs4143832 | 0.8 | 0.60 | 0.0 | 0.97 | 1.8 | 0.18 | 1.8 | 0.18 | 0.9 | 0.82 |
| rs2269426 | 3.7 | $2.5 \times 10^{-3}$ | −1.5 | 0.17 | −2.1 | $4.8 \times 10^{-2}$ | −1.7 | 0.10 | 7.0 | $3.3 \times 10^{-2}$ |
| rs3184504 | 7.9 | $3.0 \times 10^{-11}$ | 3.9 | $1.7 \times 10^{-4}$ | 3.4 | $9.5 \times 10^{-4}$ | 3.7 | $2.2 \times 10^{-4}$ | 1.5 | 0.65 |
| rs2416257 | 2.5 | 0.13 | −0.2 | 0.89 | −1.4 | 0.32 | −1.3 | 0.34 | 1.2 | 0.79 |
| rs9494145 | −7.6 | $1.4 \times 10^{-8}$ | 14.9 | $1.0 \times 10^{-36}$ | 5.2 | $7.6 \times 10^{-6}$ | 3.6 | $1.3 \times 10^{-3}$ | 1.4 | 0.71 |
| rs748065 | 0.9 | 0.46 | −0.3 | 0.79 | −0.5 | 0.62 | −0.1 | 0.91 | 1.5 | 0.66 |
| rs3939286 | −1.5 | 0.25 | −1.2 | 0.3 | −0.9 | 0.43 | −1.3 | 0.24 | 3.7 | 0.31 |

[a]Effects are given in percentage of standard units.

The sequence variants associating with eosinophil counts clustered into two groups; those having a broad effect (association P<0.01) on the majority of the blood cell types and counts, the association of all fifteen SNPs with asthma was assessed, since some of the five remaining suggestive loci may yet be true positives.

The association of SNPs identified in the eosinophil genome-wide scan with asthma in seven sample sets (European and one East Asian sample set) are shown below in Tables 10 and 11.

TABLE 10

| Sample | Control Freq (N) | Asthma Freq (N) | Asthma OR (95% CI) | Asthma P | Atopic Asthma Freq (N) |
|---|---|---|---|---|---|
| rs1420101 A - in the IL1RL1 gene ||||||
| Iceland | 40.6 (38,349) | 43.9 (2,227) | 1.15 (1.07, 1.23) | $8.7 \cdot 10^{-5}$ | 42.8 (881) |
| Australia I[a] | 36.8 (511) | 42.8 (607) | 1.28 (1.08, 1.52) | 0.0041 | 43.6 (499) |
| Australia II[a] | 38.2 (1,184) | 40.8 (1,195) | 1.11 (0.99, 1.25) | 0.069 | 41.8 (713) |
| Germany I[a] | 35.5 (499) | 37.0 (227) | 1.07 (0.85, 1.35) | 0.57 | 37.6 (206) |
| Germany II[a] | 32.9 (157[b]) | 34.9 (548) | 1.09 (0.93, 1.29) | 0.29 | 35.5 (409) |
| UK[a] | 38.1 (218) | 43.5 (283) | 1.25 (0.97, 1.61) | 0.085 | 48.4 (64) |
| Denmark[a] | 37.1 (1,320) | 40.3 (842) | 1.14 (1.01, 1.29) | 0.039 | 41.0 (518) |
| Netherlands[a] | 35.6 (1,967) | 39.7 (455) | 1.19 (1.03, 1.39) | 0.021 | 42.5 (162) |
| Italy[a] | 38.1 (280[b]) | 43.7 (308) | 1.26 (1.03, 1.55) | 0.025 | 44.0 (282) |
| Korea[a] | 34.0 (405) | 38.8 (1,304) | 1.23 (1.04, 1.45) | 0.013 | 39.6 (797) |
| Combined | — (44,890) | — (7,996) | 1.16 (1.11, 1.21) | $5.5 \cdot 10^{-12}$ | — (4531) |
| rs3939286 A - near the IL33 gene ||||||
| Iceland | 24.8 (38,336) | 27.1 (2,231) | 1.13 (1.04, 1.21) | 0.0023 | 26.9 (883) |
| Australia I | 24.7 (507) | 28.9 (634) | 1.24 (1.03, 1.49) | 0.024 | 28.9 (521) |
| Australia II | 25.2 (1,187) | 25.9 (1,199) | 1.04 (0.91, 1.18) | 0.60 | 26.4 (715) |
| Germany I | 25.0 (502) | 31.4 (204) | 1.37 (1.06, 1.77) | 0.015 | 32.6 (187) |
| Germany II | 20.4 (157[b]) | 21.6 (548) | 1.08 (0.90, 1.30) | 0.41 | 20.9 (409) |
| UK | 26.2 (166) | 28.1 (286) | 1.10 (0.81, 1.50) | 0.53 | 32.0 (64) |
| Denmark | 25.0 (1,342) | 26.3 (858) | 1.07 (0.93, 1.23) | 0.33 | 27.0 (521) |
| Netherlands | 25.7 (1,953) | 28.8 (435) | 1.17 (0.99, 1.39) | 0.067 | 32.6 (167) |
| Italy | 29.4 (280[b]) | 32.4 (309) | 1.15 (0.92, 1.44) | 0.22 | 32.3 (283) |
| Korea | 3.5 (567) | 3.2 (1,463) | 0.92 (0.63, 1.34) | 0.66 | 3.4 (879) |
| Combined | — (44,997) | — (8,167) | 1.12 (1.07, 1.17) | $5.3 \cdot 10^{-6}$ | — (4629) |
| rs2416257 G - near the WDR36 gene ||||||
| Iceland | 85.2 (38,229) | 86.4 (2,225) | 1.10 (1.00, 1.21) | 0.050 | 87.0 (880) |
| Australia I | 87.5 (452) | 87.9 (627) | 1.04 (0.80, 1.34) | 0.79 | 88.2 (516) |
| Australia II | 86.1 (1,188) | 87.2 (1,193) | 1.10 (0.93, 1.30) | 0.26 | 87.6 (711) |
| Germany I | 81.2 (497) | 88.8 (241) | 1.84 (1.34, 2.51) | 0.00014 | 89.3 (220) |
| Germany II | 84.8 (157[b]) | 84.4 (548) | 0.97 (0.78, 1.21) | 0.80 | 85.1 (409) |
| UK | 81.1 (222) | 86.9 (287) | 1.55 (1.11, 2.18) | 0.011 | 89.1 (64) |
| Denmark | 86.4 (1,324) | 88.1 (857) | 1.17 (0.97, 1.40) | 0.095 | 88.3 (523) |
| Netherlands | 85.5 (1,920) | 84.3 (455) | 0.91 (0.74, 1.12) | 0.37 | 85.1 (165) |
| Italy | 85.4 (280[b]) | 89.6 (310) | 1.46 (1.08, 1.99) | 0.015 | 90.1 (284) |
| Korea | 94.4 (603) | 95.4 (1,506) | 1.23 (0.91, 1.66) | 0.18 | 95.5 (905) |
| Combined | — (44,872) | — (8,249) | 1.13 (1.06, 1.20) | 0.00012 | — (4677) |

TABLE 10-continued

| | | | rs9494145 T - near the MYB gene | | |
|---|---|---|---|---|---|
| Iceland | 75.7 (38,365) | 75.7 (2,226) | 1.00 (0.93, 1.09) | 0.91 | 76.5 (883) |
| Australia I | 76.4 (509) | 77.3 (631) | 1.05 (0.87, 1.28) | 0.61 | 77.8 (521) |
| Australia II | 75.3 (1,186) | 77.8 (1,197) | 1.15 (1.01, 1.32) | 0.037 | 77.3 (715) |
| Germany I | 78.3 (525) | 83.0 (259) | 1.36 (1.04, 1.77) | 0.027 | 83.1 (236) |
| Germany II | 73.7 (157[b]) | 77.8 (546) | 1.25 (1.03, 1.51) | 0.023 | 78.7 (407) |
| UK | 76.8 (203) | 76.7 (286) | 0.99 (0.74, 1.34) | 0.97 | 76.2 (61) |
| Denmark | 76.1 (1,327) | 79.0 (858) | 1.18 (1.02, 1.36) | 0.030 | 78.6 (525) |
| Netherlands | 78.4 (1,941) | 77.1 (458) | 0.93 (0.78, 1.10) | 0.39 | 77.3 (166) |
| Italy | 74.9 (280[b]) | 75.3 (308) | 1.02 (0.80, 1.30) | 0.85 | 75.8 (282) |
| Korea | 68.3 (525) | 70.9 (1381) | 1.13 (0.97, 1.32) | 0.12 | 72.2 (830) |
| Combined | — (45,018) | — (8,150) | 1.07 (1.02, 1.13) | 0.0037 | — (4626) |

| | Atopic Asthma | | | Non-atopic asthma | | |
|---|---|---|---|---|---|---|
| Sample | OR (95% CI) | P | | Freq (N) | OR (95% CI) | P |
| | | | rs1420101 A - in the IL1RL1 gene | | | |
| Iceland | 1.10 (1.00, 1.21) | 0.059 | | 44.9 (690) | 1.19 (1.07, 1.32) | 0.0015 |
| Australia I[a] | 1.33 (1.11, 1.59) | 0.0018 | | 39.1 (101) | 1.10 (0.81, 1.51) | 0.53 |
| Australia II[a] | 1.16 (1.02, 1.33) | 0.029 | | 38.8 (447) | 1.03 (0.88, 1.20) | 0.75 |
| Germany I[a] | 1.10 (0.86, 1.39) | 0.45 | | 31.0 (21) | 0.82 (0.42, 1.58) | 0.54 |
| Germany II[a] | 1.13 (0.94, 1.35) | 0.20 | | 33.1 (139) | 1.02 (0.79, 1.31) | 0.89 |
| UK[a] | 1.53 (1.03, 2.27) | 0.037 | | 31.0 (21) | 0.73 (0.37, 1.43) | 0.36 |
| Denmark[a] | 1.18 (1.02, 1.36) | 0.029 | | 39.0 (323) | 1.08 (0.91, 1.29) | 0.38 |
| Netherlands[a] | 1.31 (1.04, 1.65) | 0.022 | | 40.4 (31) | 1.22 (0.73, 2.05) | 0.44 |
| Italy[a] | 1.26 (1.02, 1.56) | 0.035 | | 39.9 (22) | 1.06 (0.58, 1.96) | 0.84 |
| Korea[a] | 1.27 (1.07, 1.52) | 0.0068 | | 37.6 (489) | 1.17 (0.97, 1.43) | 0.11 |
| Combined | 1.18 (1.12, 1.24) | $5.9 \cdot 10^{-10}$ | | — (2284) | 1.11 (1.04, 1.19) | 0.0017 |
| | | | rs3939286 A - near the IL33 gene | | | |
| Iceland | 1.11 (1.00, 1.24) | 0.048 | | 25.6 (694) | 1.04 (0.92, 1.18) | 0.48 |
| Australia I | 1.24 (1.02, 1.51) | 0.030 | | 28.3 (106) | 1.21 (0.86, 1.68) | 0.27 |
| Australia II | 1.06 (0.92, 1.24) | 0.41 | | 25.3 (449) | 1.00 (0.84, 1.20) | 0.98 |
| Germany I | 1.45 (1.12, 1.89) | 0.0051 | | 17.6 (17) | 0.64 (0.27, 1.51) | 0.31 |
| Germany II | 1.02 (0.83, 1.25) | 0.83 | | 24.0 (139) | 1.22 (0.94, 1.58) | 0.14 |
| UK | 1.33 (0.85, 2.08) | 0.22 | | 23.8 (21) | 0.88 (0.42, 1.85) | 0.74 |
| Denmark | 1.11 (0.94, 1.30) | 0.23 | | 25.4 (336) | 1.02 (0.84, 1.24) | 0.83 |
| Netherlands | 1.36 (1.07, 1.74) | 0.013 | | 20.9 (31) | 0.77 (0.42, 1.41) | 0.39 |
| Italy | 1.14 (0.90, 1.43) | 0.28 | | 34.0 (22) | 1.23 (0.63, 2.37) | 0.54 |
| Korea | 0.95 (0.63, 1.43) | 0.81 | | 3.0 (566) | 0.85 (0.53, 1.35) | 0.48 |
| Combined | 1.14 (1.07, 1.21) | $2.2 \cdot 10^{-5}$ | | — (2381) | 1.04 (0.96, 1.12) | 0.33 |

TABLE 10-continued

| | | | | | | |
|---|---|---|---|---|---|---|
| rs2416257 G - near the WDR36 gene | | | | | | |
| Iceland | 1.17 (1.02, 1.34) | 0.029 | 85.5 (691) | 1.03 (0.88, 1.19) | 0.74 | |
| Australia I | 1.07 (0.81, 1.40) | 0.65 | 85.6 (104) | 0.85 (0.55, 1.32) | 0.46 | |
| Australia II | 1.14 (0.94, 1.39) | 0.18 | 86.8 (448) | 1.06 (0.85, 1.33) | 0.59 | |
| Germany I | 1.94 (1.40, 2.69) | $7.2 \cdot 10^{-5}$ | 83.3 (21) | 1.16 (0.51, 2.62) | 0.72 | |
| Germany II | 1.03 (0.81, 1.31) | 0.81 | 82.6 (139) | 0.86 (0.63, 1.17) | 0.33 | |
| UK | 1.90 (1.07, 3.37) | 0.028 | 85.7 (21) | 1.40 (0.59, 3.33) | 0.45 | |
| Denmark | 1.20 (0.96, 1.48) | 0.11 | 87.8 (333) | 1.14 (0.88, 1.47) | 0.31 | |
| Netherlands | 0.98 (0.71, 1.34) | 0.88 | 71.1 (28) | 0.43 (0.23, 0.80) | 0.0075 | |
| Italy | 1.52 (1.10, 2.09) | 0.011 | 83.5 (22) | 0.84 (0.37, 1.91) | 0.69 | |
| Korea | 1.26 (0.90, 1.75) | 0.17 | 95.2 (583) | 1.18 (0.82, 1.70) | 0.36 | |
| Combined | 1.20 (1.11, 1.29) | $4.2 \cdot 10^{-6}$ | — (2390) | 1.01 (0.92, 1.12) | 0.78 | |
| rs9494145 T - near the MYB gene | | | | | | |
| Iceland | 1.05 (0.94, 1.17) | 0.42 | 75.0 (691) | 0.96 (0.85, 1.09) | 0.55 | |
| Australia I | 1.08 (0.88, 1.33) | 0.45 | 76.2 (103) | 0.99 (0.69, 1.41) | 0.95 | |
| Australia II | 1.12 (0.96, 1.30) | 0.16 | 78.9 (447) | 1.23 (1.02, 1.47) | 0.029 | |
| Germany I | 1.36 (1.03, 1.79) | 0.030 | 82.6 (23) | 1.32 (0.62, 2.80) | 0.47 | |
| Germany II | 1.33 (1.07, 1.64) | 0.0086 | 75.0 (139) | 1.08 (0.81, 1.43) | 0.61 | |
| UK | 0.97 (0.60, 1.56) | 0.89 | 73.8 (21) | 0.85 (0.41, 1.77) | 0.66 | |
| Denmark | 1.15 (0.97, 1.36) | 0.11 | 79.5 (332) | 1.22 (0.99, 1.49) | 0.063 | |
| Netherlands | 0.94 (0.72, 1.23) | 0.66 | 90.1 (30) | 2.47 (1.17, 5.25) | 0.018 | |
| Italy | 1.05 (0.81, 1.35) | 0.72 | 69.0 (22) | 0.74 (0.39, 1.42) | 0.37 | |
| Korea | 1.20 (1.02, 1.43) | 0.031 | 69.0 (533) | 1.04 (0.86, 1.24) | 0.71 | |
| Combined | 1.12 (1.05, 1.19) | 0.00024 | — (2341) | 1.06 (0.99, 1.15) | 0.10 | |

[a]Because of assay quality issues, the reported results are based on the T allele of rs950880 ($R^2$ = 0.96 in the CEU HapMap samples).
[b]An estimate of the number of un-transmitted parental alleles used as control alleles.

TABLE 11

| Sample | Control Freq (N) | Asthma | | | Atopic Asthma | | | Non-atopic Asthma | | |
|---|---|---|---|---|---|---|---|---|---|---|
| | | Freq (N) | OR (95% CI) | P | Freq (N) | OR (95% CI) | P | Freq (N) | OR (95% CI) | P |
| rs12619285 G | | | | | | | | | | |
| Iceland | 73.8 (38412) | 73.3 (1747) | 0.97 (0.89, 1.06) | 0.54 | 73.7 (691) | 1.00 (0.87, 1.14) | 0.97 | 73.9 (548) | 1.01 (0.87, 1.17) | 0.94 |
| Germany II | 72.2 (204x) | 73.3 (415) | 1.06 (0.89, 1.26) | 0.54 | 73.6 (415) | 1.09 (0.86, 1.38) | 0.48 | 73.7 (415) | 1.13 (0.76, 1.67) | 0.56 |
| Korea | 35.4 (567) | 36.6 (1472) | 1.05 (0.91, 1.21) | 0.50 | 36.6 (882) | 1.05 (0.90, 1.23) | 0.52 | 36.8 (572) | 1.06 (0.89, 1.26) | 0.50 |
| Combined | — (—) | — (—) | 1.00 (0.94, 1.07) | 0.95 | — (—) | 1.03 (0.94, 1.13) | 0.53 | — (—) | 1.04 (0.93, 1.15) | 0.52 |
| rs4857855 T | | | | | | | | | | |
| Iceland | 81.7 (38361) | 82.5 (1749) | 1.06 (0.96, 1.17) | 0.26 | 81.5 (692) | 0.99 (0.85, 1.15) | 0.86 | 82.7 (548) | 1.07 (0.90, 1.27) | 0.46 |
| Australia | 84.5 (503) | 82.4 (625) | 0.86 (0.69, 1.07) | 0.18 | 82.0 (517) | 0.84 (0.66, 1.06) | 0.13 | 83.7 (101) | 0.94 (0.62, 1.42) | 0.77 |
| Germany I | 83.0 (535) | 82.2 (264) | 0.95 (0.72, 1.25) | 0.69 | 82.6 (239) | 0.98 (0.73, 1.30) | 0.86 | 78.0 (25) | 0.73 (0.36, 1.47) | 0.38 |

TABLE 11-continued

| Sample | Control Freq (N) | Asthma Freq (N) | Asthma OR (95% CI) | Asthma P | Atopic Asthma Freq (N) | Atopic Asthma OR (95% CI) | Atopic Asthma P | Non-atopic Asthma Freq (N) | Non-atopic Asthma OR (95% CI) | Non-atopic Asthma P |
|---|---|---|---|---|---|---|---|---|---|---|
| Germany II | 85.0 (204x) | 85.4 (415) | 1.03 (0.84, 1.26) | 0.77 | 85.0 (415) | 1.05 (0.81, 1.37) | 0.70 | 87.6 (415) | 0.86 (0.54, 1.36) | 0.53 |
| UK | 85.0 (223) | 83.9 (289) | 0.92 (0.66, 1.30) | 0.64 | 89.1 (64) | 1.44 (0.79, 2.61) | 0.23 | 97.6 (21) | 7.25 (1.71, 30.72) | 0.0072 |
| Denmark | 81.7 (1329) | 81.4 (842) | 0.98 (0.84, 1.15) | 0.79 | 80.6 (511) | 0.93 (0.78, 1.12) | 0.46 | 82.4 (330) | 1.05 (0.84, 1.31) | 0.66 |
| Korea | 82.3 (1938) | 82.3 (445) | 1.00 (0.83, 1.20) | 0.99 | 83.5 (154) | 1.09 (0.79, 1.48) | 0.61 | 88.0 (29) | 1.57 (0.74, 3.33) | 0.24 |
| Netherlands | 68.2 (565) | 70.8 (1444) | 1.13 (0.97, 1.31) | 0.11 | 70.0 (871) | 1.09 (0.92, 1.28) | 0.32 | 72.1 (555) | 1.20 (1.00, 1.44) | 0.047 |
| Combined | — (—) | — (—) | 1.02 (0.96, 1.09) | 0.44 | — (—) | 1.00 (0.92, 1.08) | 0.94 | — (—) | 1.09 (0.99, 1.21) | 0.082 |
| | | | | rs4143832 C | | | | | | |
| Iceland | 15.5 (38387) | 16.1 (2286) | 1.05 (0.96, 1.15) | 0.30 | 15.7 (887) | 1.02 (0.88, 1.17) | 0.83 | 17.3 (703) | 1.14 (0.98, 1.34) | 0.097 |
| Australia | 16.7 (504) | 16.7 (635) | 1.00 (0.80, 1.25) | 0.99 | 17.7 (522) | 1.08 (0.86, 1.35) | 0.53 | 12.3 (106) | 0.70 (0.46, 1.07) | 0.10 |
| Germany I | 18.3 (517) | 21.9 (285) | 1.26 (0.97, 1.62) | 0.080 | 22.9 (258) | 1.33 (1.02, 1.72) | 0.034 | 13.0 (27) | 0.67 (0.31, 1.44) | 0.30 |
| Germany II | 23.0 (204x) | 23.1 (415) | 1.01 (0.84, 1.21) | 0.95 | 24.4 (415) | 0.99 (0.78, 1.26) | 0.94 | 20.8 (415) | 1.17 (0.75, 1.83) | 0.49 |
| UK | 14.7 (221) | 17.5 (286) | 1.23 (0.88, 1.72) | 0.23 | 20.2 (62) | 1.46 (0.87, 2.47) | 0.15 | 14.3 (21) | 0.97 (0.39, 2.38) | 0.94 |
| Denmark | 19.9 (1327) | 19.4 (859) | 0.97 (0.83, 1.13) | 0.68 | 18.9 (525) | 0.94 (0.78, 1.12) | 0.47 | 20.3 (333) | 1.02 (0.83, 1.27) | 0.83 |
| Korea | 16.3 (581) | 16.8 (1471) | 1.04 (0.86, 1.24) | 0.70 | 16.9 (888) | 1.05 (0.86, 1.28) | 0.66 | 16.8 (566) | 1.04 (0.83, 1.29) | 0.74 |
| Combined | — (—) | — (—) | 1.04 (0.98, 1.11) | 0.19 | — (—) | 1.04 (0.96, 1.13) | 0.30 | — (—) | 1.05 (0.95, 1.16) | 0.34 |
| | | | | rs9494145 T | | | | | | |
| Iceland | 75.7 (38,365) | 75.6 (2,117) | 1.00 (0.92, 1.08) | 0.98 | 76.5 (880) | 1.05 (0.92, 1.18) | 0.48 | 75.0 (686) | 0.96 (0.84, 1.11) | 0.61 |
| Australia | 76.4 (509) | 77.3 (631) | 1.05 (0.87, 1.28) | 0.61 | 77.8 (521) | 1.08 (0.88, 1.33) | 0.45 | 76.2 (103) | 0.99 (0.69, 1.41) | 0.95 |
| Germany I | 78.3 (525) | 83.0 (259) | 1.36 (1.04, 1.77) | 0.027 | 83.1 (236) | 1.36 (1.03, 1.79) | 0.030 | 82.6 (23) | 1.32 (0.62, 2.80) | 0.47 |
| Germany II | 73.6 (204[b]) | 77.7 (415) | 1.25 (1.04, 1.51) | 0.021 | 79.4 (319) | 1.31 (1.03, 1.68) | 0.030 | 76.2 (96) | 1.28 (0.82, 2.01) | 0.28 |
| UK | 76.6 (203) | 78.1 (263) | 1.09 (0.80, 1.49) | 0.58 | 76.2 (61) | 0.98 (0.61, 1.58) | 0.93 | 73.8 (21) | 0.86 (0.41, 1.79) | 0.69 |
| Denmark | 76.1 (1,327) | 79.0 (858) | 1.18 (1.02, 1.36) | 0.030 | 78.6 (525) | 1.15 (0.97, 1.36) | 0.11 | 79.5 (332) | 1.22 (0.99, 1.49) | 0.063 |
| Netherlands | 78.4 (1,941) | 77.1 (458) | 0.93 (0.78, 1.10) | 0.39 | 77.3 (166) | 0.94 (0.72, 1.23) | 0.66 | 90.1 (30) | 2.47 (1.17, 5.25) | 0.018 |
| Korea | 68.3 (525) | 70.9 (1,381) | 1.13 (0.97, 1.32) | 0.12 | 72.2 (830) | 1.20 (1.02, 1.43) | 0.031 | 69.0 (533) | 1.04 (0.86, 1.24) | 0.71 |
| Combined | | | 1.06 (1.01, 1.12) | 0.020 | — (—) | 1.12 (1.05, 1.20) | 0.0013 | — (—) | 1.05 (0.96, 1.15) | 0.25 |
| | | | | rs3184504 T | | | | | | |
| Iceland | 38.2 (38314) | 37.6 (2273) | 0.98 (0.91, 1.04) | 0.48 | 36.7 (881) | 0.94 (0.84, 1.05) | 0.26 | 39.4 (699) | 1.05 (0.93, 1.19) | 0.40 |
| Australia | 49.7 (511) | 45.6 (622) | 0.85 (0.72, 1.00) | 0.050 | 45.7 (513) | 0.85 (0.72, 1.01) | 0.070 | 45.7 (104) | 0.85 (0.63, 1.15) | 0.29 |
| Germany I | 49.4 (533) | 50.9 (282) | 1.06 (0.86, 1.30) | 0.58 | 51.0 (254) | 1.06 (0.86, 1.31) | 0.57 | 50.0 1.02 (28) | (0.60, 1.75) | 0.93 |
| Germany II | 46.3 (204x) | 46.4 (415) | 1.01 (0.86, 1.18) | 0.94 | 46.1 (415) | 0.94 (0.76, 1.16) | 0.57 | 53.0 (415) | 0.87 (0.61, 1.25) | 0.46 |
| UK | 47.0 (217) | 44.0 (285) | 0.89 (0.69, 1.14) | 0.35 | 50.8 (62) | 1.16 (0.78, 1.74) | 0.45 | 50.0 (21) | 1.13 (0.60, 2.13) | 0.71 |
| Denmark | 51.2 (1204) | 51.3 (850) | 1.00 (0.89, 1.13) | 0.98 | 49.1 (520) | 0.92 (0.79, 1.06) | 0.26 | 54.6 (329) | 1.14 (0.96, 1.36) | 0.13 |
| Combined | | | 0.97 (0.92, 1.02) | 0.26 | | 0.94 (0.88, 1.00) | 0.069 | | 1.04 (0.96, 1.14) | 0.33 |
| | | | | rs2269426 T | | | | | | |
| Iceland | 32.3 (38394) | 34.5 (2222) | 1.11 (1.03, 1.19) | 0.0058 | 32.7 (877) | 1.02 (0.91, 1.14) | 0.74 | 36.9 (693) | 1.23 (1.08, 1.39) | 0.0012 |
| Australia | 36.0 (501) | 34.8 (625) | 0.95 (0.80, 1.13) | 0.54 | 36.0 (514) | 1.00 (0.84, 1.19) | 0.99 | 30.3 (104) | 0.77 (0.56, 1.06) | 0.11 |
| Germany I | 42.1 (532) | 46.2 (263) | 1.18 (0.96, 1.46) | 0.12 | 46.8 (237) | 1.21 (0.97, 1.51) | 0.084 | 40.4 (26) | 0.93 (0.53, 1.64) | 0.81 |

TABLE 11-continued

| Sample | Control Freq (N) | Asthma | | | Atopic Asthma | | | Non-atopic Asthma | | |
|---|---|---|---|---|---|---|---|---|---|---|
| | | Freq (N) | OR (95% CI) | P | Freq (N) | OR (95% CI) | P | Freq (N) | OR (95% CI) | P |
| Germany II | 42.8 (204x) | 40.5 (415) | 0.91 (0.77, 1.07) | 0.25 | 38.0 (415) | 0.91 (0.73, 1.14) | 0.40 | 36.1 (415) | 0.63 (0.43, 0.93) | 0.019 |
| UK | 34.7 (215) | 38.1 (289) | 1.16 (0.89, 1.50) | 0.27 | 35.2 (64) | 1.02 (0.68, 1.55) | 0.92 | 31.0 (21) | 0.85 (0.43, 1.67) | 0.63 |
| Denmark | 38.0 (1172) | 33.8 (470) | 0.83 (0.71, 0.98) | 0.024 | 35.4 (260) | 0.89 (0.73, 1.09) | 0.26 | 31.6 (209) | 0.75 (0.60, 0.94) | 0.011 |
| Korea | 31.0 (578) | 30.1 (1475) | 0.96 (0.83, 1.11) | 0.59 | 30.4 (890) | 0.98 (0.83, 1.15) | 0.77 | 29.4 (567) | 0.93 (0.78, 1.11) | 0.40 |
| Combined | — (—) | — (—) | 1.03 (0.98, 1.08) | 0.27 | — (—) | 1.00 (0.93, 1.07) | 0.99 | — (—) | 0.99 (0.91, 1.08) | 0.86 |
| rs748065 A | | | | | | | | | | |
| Iceland | 69.4 (38154) | 69.7 (2221) | 1.02 (0.94, 1.09) | 0.67 | 70.0 (880) | 1.03 (0.92, 1.16) | 0.60 | 68.2 (690) | 0.95 (0.83, 1.08) | 0.40 |
| Australia | 69.5 (521) | 70.3 (631) | 1.04 (0.87, 1.24) | 0.68 | 70.5 (523) | 1.05 (0.87, 1.26) | 0.63 | 70.6 (102) | 1.05 (0.76, 1.46) | 0.75 |
| Germany I | 69.3 (526) | 75.0 (270) | 1.33 (1.05, 1.68) | 0.017 | 75.2 (244) | 1.34 (1.06, 1.71) | 0.016 | 73.1 (26) | 1.20 (0.65, 2.23) | 0.56 |
| Germany II | 64.1 (204x) | 65.1 (415) | 1.04 (0.88, 1.24) | 0.62 | 63.9 (415) | 1.17 (0.93, 1.47) | 0.19 | 61.2 (415) | 1.03 (0.69, 1.54) | 0.87 |
| UK | 75.8 (223) | 71.9 (290) | 0.82 (0.62, 1.08) | 0.16 | 72.7 (64) | 0.85 (0.54, 1.33) | 0.47 | 66.7 (21) | 0.64 (0.32, 1.28) | 0.20 |
| Denmark | 69.6 (1328) | 70.2 (861) | 1.03 (0.90, 1.17) | 0.69 | 70.4 (525) | 1.04 (0.89, 1.21) | 0.63 | 70.0 (335) | 1.02 (0.85, 1.23) | 0.83 |
| Korea | 43.8 (578) | 42.6 (1451) | 0.95 (0.83, 1.09) | 0.49 | 42.8 (878) | 0.96 (0.83, 1.12) | 0.59 | 42.4 (556) | 0.94 (0.80, 1.11) | 0.50 |
| Combined | — (—) | — (—) | 1.02 (0.97, 1.07) | 0.46 | — (—) | 1.05 (0.98, 1.12) | 0.17 | — (—) | 0.97 (0.89, 1.05) | 0.46 |

SNPs belonging to three loci, rs1420101 on 2q11 in the IL1RL1 (interleukin 1 receptor-like 1) gene, rs3939286 on 9p24 near the IL33 (interleukin 33) gene, and rs2416257 on 5q22 in the WDR36 (WD repeat domain 36) gene, satisfied our criteria for significance after accounting for the testing of fifteen SNPs in three phenotypes (P<0.05/15/3=0.0011). The asthma risk alleles for all three SNPs were the alleles correlating (although only significantly for IL1RL1) with increased blood eosinophil counts (Tables 4 and 7). For the IL33 and WDR36SNPs, the observed association with atopic asthma was stronger than that for non-atopic asthma (Table 7). The A allele of rs1420101 on 2q11 also correlated positively with serum IgE (P=2.1·$10^{-5}$), but with none of the other measured blood parameters (FIG. 5). The other two SNPs did not associate with any of the other blood parameters measured. Our genotyping assay for rs1420101 did not give good results on amplified DNA and we therefore used rs950880 as a surrogate for most of the non-Icelandic samples ($R^2$=0.96 in the CEU HapMap samples).

SNP (rs9494145) on 6q23 is located between the HBS1L (HBS1-like (*S. cerevisiae*)) and MYB (v-myb myeloblastosis viral oncogene homolog (avian)) genes. The T. allele of this marker showed genome-wide significant association to blood eosinophil counts (Table 6). The same allele showed association to asthma, in particular atopic asthma. The MYB gene acts as a nuclear transcription factor that is implicated in proliferation, survival and differentiation of hematopoietic stem and progenitor cells (Martinez-Moczygemba et al., *J Allergy Clin Immunol* 112: 653-65 (2003). The HBS1L gene belongs to the GTP-binding elongation factor family and could as such be involved in regulating variety of cellular processes.

The SNP rs1420101 on 2q11 is located in a linkage disequilibrium (LD) block that contains four genes: IL1RL1, IL18R1 (interleukin 18 receptor 1), IL18RAP (interleukin 18 receptor associated protein) and SLC9A4 (solute carrier family 9). SNPs in this LD block have previously been associated with Crohn's disease (rs917997) (Zhernakova et al., *Am J Hum Genet.* 82: 1202-1210 (2008)) and celiac disease (rs917997 and rs13015714) (Hunt et al., *Nat Genet.* 40: 395-402 (2008)) as well as atopic dermatitis (AD) (rs6543116) (Shimizu et al., *Hum Mol Genet.* 14: 2919-2927 (2005)) and asthma (rs1974675) (Zhu et al., *Eur J Hum Genet.* 16: 1083-1090 (2008)). The Crohn's and celiac diseases variants are not correlated with rs1420101, and these variants did not associate with either eosinophil counts or asthma in our samples (data not shown). The AD variant is in weak LD with rs1420101, and rs1420101 did not associate with AD in the previous study (Shimizu et al., 2005, supra). The rs1974675 SNP was recently shown to associate with asthma in a candidate gene study (Zhu et al., 2008, supra). This SNP is in LD with rs1420101 (D'=1, $R^2$=0.27, in the European HapMap data (Nature 437: 1299-1320 (2005)) but has not been typed in our asthma or eosinophil sample sets. However, another SNP (rs10206753) that is on the Illumina chip and is in much stronger LD with rs1974675 than rs1420101 (D'=1, $R^2$=0.96, in the European HapMap data (Nature 437: 1299-1320 (2005)) shows weaker association than rs1420101 with eosinophil counts (P=0.00031 vs. P=6.8·$10^{-6}$) and asthma (P=0.00057 vs. P=0.00013) in the Icelandic discovery sample set. Furthermore, its association with asthma and eosinophil counts could be accounted for by rs1420101 (P>0.18 for both eosinophil counts and asthma), while the association of rs1420101 could not be accounted for by rs1974675 (P=0.0022 for eosinophil counts and P=0.025 for asthma).

The SNP rs1420101 is located in the IL1RL1 (also known as ST2) gene. The protein encoded by this gene has three splice variants, a soluble secreted form of ST2, a transmembrane form ST2L, and ST2V, localized at the plasma membrane, but lacking a substantial intracellular portion, suggesting that it may be a decoy for ligands of ST2L (Tago et al., *Biochem Biophys Res Commun* 285: 1377-1383 (2001)).

Rs1420101 is in an exon that is alternatively spliced and only present in the ST2V form. A second variant associating with asthma, rs3939286, located on 9p24, 32 kb proximal to the coding start of the IL33 gene, that encodes a cytokine belonging to the IL1 super family, and is the natural ligand for the IL1RL1/ST2 receptor (Schmitz et al., *Immunity* 23: 479-490 (2005)). IL33 can also function as a chromatin associated nuclear factor with transcriptional regulatory properties (Carriere et al., *Proc Natl Aced Sci USA* 104: 282-287 (2007)). Signalling through the IL1RL1/ST2-IL33 complex plays an important role in eosinophil maturation, survival and activation, both by direct effects on eosinophils and indirectly through recruitment and regulation of Th 2 cell effector functions (Chemy et al., *J Allergy Clin Immunol* 121: 1484-1490 (2008)). Furthermore, the effect of IL1RL1/ST2-IL33 on eosinophil effector functions is as potent as that of IL5 (Schmitz et al., 2005, supra). These functions are consistent with a major contribution of IL1RL1/ST2-IL33 signaling in eosinophil-mediated inflammation (Cherry et al., 2008, supra), such as the one encountered in asthma. Although the 2q11 variant is located within the IL1RL1 gene, the other genes within the same LD block-IL18R1, IL18RAP and SLC9A4- can not be excluded as genes involved. IL18R1 and IL18RAP encode the receptor for the IL-18 cytokine that has been implicated in inflammatory diseases, including asthma.

The SNP rs2416257, the most strongly associated SNP at the 5q22 locus, is located in an LD block that contains the WDR36 and TSLP (thymic stromal lymphopoietin isoform 1) genes. WDR36 encodes a T-cell activation protein with a minimum of eight WD40 repeats that is highly co-regulated with interleukin 2 (IL2) (Mao et al., *Genomics* 83: 989-999 (2004)). TSLP encodes an interleukin 7-like cytokine that is expressed within the thymus and peripheral tissues and regulates dendritic cell-mediated central tolerance, peripheral T cell homeostasis, and inflammatory Th2 response. TSLP is a key initiator of allergic airway inflammation in mice (Zhou et al., *Nat Immunol* 6: 1047-1053 (2005)) and its expression is increased in the airways of patients with asthma and correlates with expression of Th2-attracting chemokines and disease severity (Ying et al., *J Immunol.* 174: 8183-8190 (2005)).

Example 4

This example demonstrates the association of the SNPs identified through the blood eosinophil counts with myocardial infarction.

The association of the 15 SNPs identified through the blood eosinophil counts scan were examined in chronic obstructive pulmonary disease (COPD) and myocardial infarction (MI) using Icelandic genome-wide scan data (Helgadottir et al., *Science* 316: 1491 (2007)).

None of the SNPs associated significantly with COPD (N cases=765, N controls=39,376). As shown in Table 12, two SNPs: the T allele of rs3184504 and the G allele of rs653178, both located in the SH2B3 gene on chromosome 12, associated significantly with MI (P<0.002).

TABLE 12

| SNP/Allele | Chr | N | Freq | OR (95% CI) | P value |
|---|---|---|---|---|---|
| rs1420101 A | 2 | 2,627/33,714 | 41.2/40.8 | 1.02 (0.96, 1.08) | 0.55 |
| rs12619285 A | 2 | 2,626/33,722 | 73.7/73.6 | 1.01 (0.94, 1.08) | 0.88 |
| rs4857855 C | 3 | 2,627/33,721 | 81.7/81.7 | 1.00 (0.93, 1.09) | 0.90 |
| rs7635061 A | 3 | 2,627/33,722 | 74.2/74.0 | 1.01 (0.94, 1.08) | 0.87 |
| rs2416257 G | 5 | 2,619/33,568 | 85.1/85.2 | 0.99 (0.91, 1.08) | 0.78 |
| rs184941 G | 5 | 2,626/33,,723 | 74.1/74.3 | 0.99 (0.92, 1.06) | 0.77 |
| rs4143832 A | 5 | 2,623/33,703 | 15.3/15.5 | 0.99 (0.91, 1.08) | 0.80 |
| rs2079103 T | 5 | 2,625/33,727 | 21.0/21.3 | 0.98 (0.91, 1.05) | 0.54 |
| rs2269426 T | 6 | 2,625/33,701 | 32.9/32.3 | 1.03 (0.96, 1.09) | 0.44 |
| rs9494145 T | 6 | 2,627/33,710 | 75.6/75.7 | 1.00 (0.93, 1.07) | 0.91 |
| rs748065 A | 8 | 2,594/33,486 | 69.0/69.5 | 0.98 (0.92, 1.05) | 0.51 |
| rs1412426 T | 9 | 2,626/33,713 | 33.5/33.0 | 1.03 (0.96, 1.09) | 0.42 |
| rs3939286 A | 9 | 2,626/33,720 | 25.3/24.8 | 1.03 (0.96, 1.10) | 0.44 |
| rs3184504 T | 12 | 2,625/33,625 | 40.4/38.0 | 1.11 (1.04, 1.18) | 0.0012 |
| rs653178 G | 12 | 2,627/33,724 | 40.7/38.3 | 1.10 (1.04, 1.18) | 0.0016 |

The association of both SNPs with MI was subsequently analyzed in six sample sets of European ancestry: an Icelandic replication set, three American replication sets (Duke, Emory, UPenn), New Zealand, and Verona. The results are shown in Tables 13 and 14.

TABLE 13

| | rs653178 G allele | | | |
|---|---|---|---|---|
| Sample Set | N (case/ctrl) | Freq (case/ctrl) | OR (95% CI) | P value |
| Iceland discovery | 2,627/33,724 | 40.7/38.3 | 1.10 (1.04, 1.18) | 0.0016 |
| Iceland replication | 343/3709 | 42.6/38.6 | 1.18 (1.01, 1.38) | 0.041 |
| US - Duke | 1210/733 | 49.9/44.2 | 1.26 (1.10, 1.43) | 0.00054 |
| US - Emory | 603/1234 | 48.8/46.5 | 1.10 (0.95, 1.26) | 0.19 |
| US - UPenn | 676/463 | 54.4/53.8 | 1.03 (0.87, 1.21) | 0.76 |
| New Zealand | 567/511 | 48.1/45.5 | 1.11 (0.94, 1.31) | 0.23 |
| Verona | 643/388 | 52.7/50.0 | 1.12 (0.93, 1.33) | 0.23 |
| Combined replication | | | 1.14 (1.07, 1.21) | $5.0 \cdot 10^{-5}$ |
| Combined | | | 1.12 (1.07, 1.17) | $4.5 \cdot 10^{-7}$ |

TABLE 14

| | rs3184504 - T allele | | | |
|---|---|---|---|---|
| Sample Set | N (case/ctrl) | Freq (case/ctrl) | OR (95% CI) | P value |
| Iceland discovery | 2,625/33,625 | 40.4/38.0 | 1.11 (1.04, 1.18) | 0.0012 |
| Iceland replication | 343/3,700 | 42.0/38.2 | 1.17 (1.00, 1.37) | 0.053 |
| US, Durham | 1,209/730 | 49.7/43.9 | 1.26 (1.11, 1.44) | 0.00045 |

TABLE 14-continued rs3184504 - T allele

| Sample Set | N (case/ctrl) | Freq (case/ctrl) | OR (95% CI) | P value |
|---|---|---|---|---|
| US, Atlanta | 588/1,216 | 49.7/46.7 | 1.13 (0.98, 1.29) | 0.096 |
| US, Philadelphia | 681/462 | 53.7/54.1 | 0.99 (0.83, 1.17) | 0.86 |
| New Zealand | 558/501 | 49.2/45.2 | 1.17 (0.99, 1.39) | 0.067 |
| Verona | 646/387 | 53.1/49.5 | 1.16 (0.97, 1.38) | 0.11 |
| Combined replication | | | 1.15 (1.08, 1.23) | $1.1 \cdot 10^{-5}$ |
| Combined | | | 1.13 (1.08, 1.18) | $8.6 \cdot 10^{-8}$ |

Similar to the blood eosinophil data (Table 1), the association with MI was slightly stronger for rs3184504 (combined OR=1.13, 95% CI: 1.08-1.18, $P=8.6 \cdot 10^{-8}$) than rs653178 (combined OR=1.12, 95% CI: 1.07-1.17, $P=4.5 \cdot 10^{-7}$). The Welcome Trust Case Control Consortium (WTCCC) has published imputed genotype counts for rs3184504 on 1,477 coronary artery disease (CAD) cases and 2,932 controls which yield an OR of 1.10 and a P value of 0.025 for the T allele (*Nature* 447: 661-678 (2007)).

rs3184504 is a non-synonymous SNP in exon 3 of the SH2B3 (SH2B adaptor protein 3) gene (also known as LNK), leading to a R262W amino acid change. This variant has previously been shown to associate with type I diabetes (Todd et al., *Nat Genet.* 39: 857-864 (2007)) and celiac disease (Hunt et al., 2008, supra). In addition to associating with eosinophil counts and increased risk of MI, the T allele of rs3184504 associates with increase of the following blood parameters: Neutrophil counts (P=0.0083), lymphocyte counts ($P=1.1 \cdot 10^{-8}$), monocyte counts (P=0.00073), white blood cell counts ($P=6.3 \cdot 10^{-6}$), platelet counts ($P=3.0 \cdot 10^{41}$), red blood cell counts (P=0.00017), hematocrit (P=0.00095) and hemoglobin (P=0.00022) (FIG. 1). A trend towards risk for hypertension was observed for rs3184504, but no association was observed between rs3184504 and other traditional risk factors for MI, such as HDL (P=0.63, N=8,269), LDL (P=0.70, N=5,615), type 2 diabetes (P=0,85, N diabetics=1,521, N controls=34,754) and smoking initiation (P=0.46, N smokers=10,521, N never smokers=5,954 (Thorgeirsson et al., *Nature* 452: 638-642 (2008)). SH2B3 is a member of the APS family of adaptor proteins acting as a broad inhibitor of growth factor and cytokine signaling pathways. Lnk deficient mice exhibit profound perturbation of hematopoiesis with increased numbers of megakaryocytes, B lymphoid and erythroid progenitor cells and well as hematopoietic stem cells (Velazquez et al., *J Exp Med* 195: 1599-1611 (2002)). The association of rs3184504 T with increased counts for all major human blood cell types further supports an important role for SH2B3 in regulating human hematopoietic progenitor and stem cell numbers. Furthermore, the observed effect of rs3184504-T is consistent with reduced activity of the SH2B3 protein. The SH2B3 gene is expressed in human vascular endothelial cells, where it modulates the proinflammatory action of TNFα, counteracting the TNFα-induced increase in leukocyte adhesion to endothelial cells, but promoting endothelial NO-synthase (eNOS) activity (Fitau et al., *J Biol Chem* 281, 20148-59 (2006)). The amino acid substitution by rs3184504 could contribute to the progression of plaques in coronary arteries leading to MI through reduced anti-inflammatory activity of SH2B3. Alternatively, rs3184504 could confer risk of MI through increased platelet or white blood cell counts since increased counts of these cells have been shown to correlate with CAD (Danesh et al., *Jame* 279: 1477-1482 (1998)).

The sequence variants at the remaining loci did not associate significantly with risk of the three diseases tested. Briefly, a SNP (rs4857855) located near the GATA2 (encoding GATA binding protein 2) gene on 3q21, associates significantly with blood eosinophil counts (Table 1), but even more significantly with blood basophil counts (effect=14.5, 95% CI: 11.8-17.2, $P=1.8 \cdot 10^{-25}$). GATA2 is a transcription factor that acts as an important regulator of hematopoiesis (Hirasawa et al., *J Exp Med* 195: 1379-1386 (2002)), affecting mainly the differentiation of cells of the eosinophil, basophil, and mast cell lineages (Iwasaki et al., *Genes Dev* 20: 3010-3021 (2006)). A SNP (rs4143832) located near the IL5 (interleukin 5 (colony-stimulating factor, eosinophil)) gene on 5q31 showed association that was restricted to blood eosinophil counts. IL5 is a growth and differentiation factor for B cells and controls the production, activation and localization of eosinophils (Martinez-Moczygemba et al., *J Allergy Clin Immunol* 112: 653-665; quiz 666 (2003)). A SNP (rs12619285) located near the IKZF2 (encoding IKAROS family zinc finger 2 (Helios)) gene on 2q13 showed association specific to blood eosinophil counts. This gene has not previously been linked to eosinophil biology but is a well know and important regulator of lymphocyte development and differentiation through transcriptional regulation[25]. Finally a SNP (rs9494145) on 6q23, between the HBS1L (HBS1-like (*S. cerevisiae*)) and MYB (v-myb myeloblastosis viral oncogene homolog (avian)) genes, showed suggestive association with most of the blood parameters measured (FIG. 5). Variants at this locus, highly correlated with rs9494145, have previously been shown to associate with fetal hemoglobin levels in adults (Thein et al., *Proc Natl Acad Sci USA* 104: 11346-11351 (2007)) and subsequently platelet, monocyte counts, and white blood cell counts (Menzel et al., *Blood* 110: 3624-3626 (2007)). The MYB gene acts as a nuclear transcription factor that is implicated in proliferation, survival and differentiation of hematopoietic stem and progenitor cells (Martinez-Moczygemba et al., *J Allergy Clin Immunol* 112: 653-665; quiz 666 (2003)). The HBS1L gene belongs to the GTP-binding elongation factor family and could as such be involved in regulating variety of cellular processes.

The results in Table 1 suggest some population heterogeneity with respect to association with eosinophil counts. First, the association of the SNP at IL5 in non-Icelandic Europeans is weaker (P=0.00055) than would have been expected based on the Icelandic data. Second, the relationship with the SNP at MYB is in the inverse direction of what would be expected (P=0.00053). The association with both SNPs is most likely true; at IL5 because of the overall level of significance ($P=6.0 \cdot 10^{-11}$) and the very strong candidacy of the IL5 locus, and at MYB because of the replicating association with hemoglobin levels and many other blood parameters. This heterogeneity is either due to the different criteria for sample inclusion or inherent differences in auto-immune stress between the different populations. In particular, the Icelandic population is known to have low exposure to parasites.

In summary, several sequence variants associating with blood eosinophil counts were discovered by performing a genome-wide association scan of a large number of individuals. Following a previous approach to smoking and lung cancer and peripheral artery disease (Thorgeirsson et al., *Nature* 452: 638-642 (2008)) and pigmentation and skin cancers (Gudbjartsson et al., *Nat Genet.* 40: 886-891 (2008)) and that of others with uric acid and gout (Vitart et al., *Nat Genet.* 40: 437-442 (2008)), the association of the variants showing the strongest suggestive association with eosinophil counts with disease was then assessed, and identified three asthma and one MI susceptibility loci. Most of the sequence variants associating with blood eosinophil counts do not associate with asthma, suggesting that the effect of the variants associating with asthma is not through eosinophil counts, but rather that both the effect on eosinophil counts and disease risk are a consequence of effects on other parts of the auto-immune system. Association data on other blood parameters show that the loci identified cluster into a group with a rather specific effect on only one or two cell types and a group of loci with a global effect on most or all cell types.

Example 5

A nominally significant association of rs3184504-T with hypertension was observed in Iceland (OR=1.05, P=0.015, N hypertensives=9,586, N controls=27,687) and a similar trend was also observed in the imputed WTCCC data (OR=1.07, P=0.11, N hypertensives=1,948, N controls=2,932). No association was found with systolic blood pressure in Iceland (P=0.27, N=13,579), while the T allele of rs3184504 correlated with higher systolic blood pressure in the 1958 birth cohort (P=0.0037, N=5,918).

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. This invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (681 sequences)

SEQ ID NO: 1 - DNA, 599 bp, Homo sapiens
ttggtgaaaaaagtaggtaacctattagtgcctgtctataaaagagtgaggacttagatttctaaatgcatactaacaagtatatttataaagacagattttattacctgattgtataaagcagaagtctcctttaacagattaaaagaagaggtgggtggaatatgctaacaaacaaaggtccatgtgtgaatcgggggatattcaggacttaactagacttcagcagactcatttaggatcttaaacactgtcccaagtccaaaattcacatttaagctgagagcagctaggactttrctatctatctatggtttaagttgtcttccactcggcttgtaaagcctagagtgtcactgtttctgcccacagatagctgtcaatcttggcccataaggagatggaaccataggaaatgtttcatctccactcccagcacttctttccatataaaaagatttccactagcacagcagtcctgacatctctgttctcaggagaagagggaatcatttaatgttattgagtccctttacctcctcattctcttgagagctatgtgcatagagaaagcatactttctgctctgctatttcaga

SEQ ID NO: 2 - DNA, 599 bp, Homo sapiens
taagatgcaaaaatatgtggtctaatatcatagttttagagaattaagaaggtaaattcatcctagagtttggatcaaacaaataatatttagaaggaatatatcataaggtgataactttgtatgtcggtatatatgtaagtgtgggtgtgtgtaaatcattaaatttccatatatataccatataattttctacctgaaatgttgtgagttaaatcaaaaaatgtaaattattcctacatatcattaatattataaattcaggaccatagttatttatatatttatttttaaaattcyggttgaagcatttggtgaaacagttccagaattgagttttttattctttctatatgtggagcatatggtaaaattattcctatttctaatatgagtttggtattttattgttaaactctagaaaacaaccaccttttagccaagaacctttgccctctaagacacactcaattgtattttacttttgctaccaacatttaggggttagtttactttgtgttatcatattccaccaatattcaaaagatttatcacttggcaagagttactgatgacactccatgagtaggaaacctcaa

SEQ ID NO: 3 - DNA, 599 bp, Homo sapiens
caaggaatggtaactggtggggttgtctttttgctgaatgaagagaagaaaagaagaattccaagtctgtttcccaggcacaggaaggaccaggaagcaaggaaacttccaattttcaagtccactgagcagaatacaagaacagggtccaaaacaaagagttctccgttgagaaccggcaagatggagcaagcaagtcctgcaggcaggctgggcctggagaggcgccaagaggccacagcactcttgggaggaggtttttctggactcttgaggagctgagacttttatattccaacsctgcctttaatttgaggtttgcctcctccctccatttgcagaagagtaatccgaagctaaatcattcataacatgagaatgctgatctgtgtccagcccttgtgaagggaaaagaaaacaaaacttcacaaacataattagtagaactacctataaaacctaatgttaaaagagaaattagctttcatggagagaaagtgtgatggcatgacacagaaattaagtgcactgaatttagatttgaaaagagtttgattcaattcatgtccctgcttcccagtagtccgtgaccttgggca

SEQ ID NO: 4 - DNA, 599 bp, Homo sapiens
ctgcagccttgatctcctaggctttagtgattttcccatctcagcctgctgagtagctgggaccacaggcacacaccactaaccctttatttatttatttatttatttatttattttgtagagacggtgtcttgctatgttgtccaggctggtctagaattcctgggctcaagggatccacctgccttggcctcccaaagtaaaagtatctttattttcctatttaaaatgctctttcagcttctgattgaatttagaatgaaatctgaacactcttctttggactacatgatgctatamgtcctggtgacagtctcccactgtctctttctgcagtggattaagcacccaattgccaagtttatctttttcaacaggtagtgaaattatgtttgtgttgttgttttgttttgttttgtttgttttgagacagggtctcactctgtcacccaggctggagtgcagtggtacactcactgtctcttgtcagtgcccctcactgtgctcagccagactggtgcacccactggcctttaaacaccctaaactcctatctgcttcaggggccttgggtttgctcttccctctaaattcagtgc

SEQ ID NO: 5 - DNA, 599 bp, Homo sapiens
gcttcttacaaatgagacctctaaatgttgaagtgctccagagcttgatctctagccatactttttcctagccctgtgaatttgtataccaccagatgccaattcctcctaaatgcgtctcctcagccttgacccaaatccaacagcatatttgacatttttacttgtataaaaatgttttaacataccaaaaacaagactcatgataattccccatcttgtcaaaatctgtgctaagattcccccatccccaattttccttacttgctcaagttgaaaatccaggggtctttgattttyccacttttatctgtcagatttgatccttctgtaactctatttctcctactacctccttggtctaaaccagcaagttttcccccatctctagcctggattactgaaatgaccaccaatctgagcttctagctctcactttttttcctgtctgcagtggattaagcacccaattgccaagtttatcttttgaacaggcagtgaaattatgtttgtgttgttttgttttgtttcgagacagggtctcactctgtcacccaggctggagtgcaatggtgcaatcatggctcactgcagccttg

SEQ ID NO: 6 - DNA, 599 bp, Homo sapiens
ggagcaggagtagacagggaaagccttcagatcatgacatgtgtgaaaggtgaggggcaggaaggaggattaagtaggaaaagcctgtgattagggtgcagctctgagaaagtctcagccagcccaaccagggagctctgtcataaagactgcccacaggggagcctgtgagttggaatggctgggaatcaggagcgttgtagtgattgtgctcagtccttacctaggagttatgtcaggaaaagcctggccttagcttaaatgctgtggtggatcccaaaggtgctatagctggaggcygtcacctaattgcattcctggcagctgatcagcaaggcctttgttagagagaggctcaggtagcacactccctggccaccataggagggttatacattttctatatgagggctctataatgttggtatgctcatggaatcaaggaggtataatggagctaacaccatcacttaatttacaaaaattagcaaagaacttaattttgttttattgatacttctaataccaacatttcttgacagaagaaaaatatttcccaatattcatttaaatggtgccaacaaaagtatttttaaaca

SEQ ID NO: 7 - DNA, 599 bp, Homo sapiens
atttgtgtgcgtgtgtgagcacacatctttccttctttgaactaagttgcaccaggcaattccttacagctgattccccaactttgtcctgaataaagccggtcagacatgggagggacaaagaaagctaaaaaccaatgagtcatctgggaatagatgttctctttactaccctttatcagaatgaggaaatgatgccttccccccaaatagaggcagtaaacagtgaagatgactgaatgcttttcttctgtctagccttcatagcacctcagcttaccaaggaaaatggagcttctrtctcatagtgagtgtgttctctcttccctacctaaagaggctgcaacatgattagggctcgtctagaagtacaaaggaagatctcagggacacaaggaagccagaaatagttgaggtcaatcaggccaggttagggttggtgctgccatactatattcctctttgacctgggcatgttttccaggaggatctatttcccttggaaagctctttaagtaacactatgtgaaatttataataaatcctctcaccccaagatgactgcttcagatatgagggggagtagtgaggaatgatgg

SEQ ID NO: 8 - DNA, 599 bp, Homo sapiens
tttgacatctgctaagctattagacaccagtttttaaagaaataaaccattccctgtacatagaattagaaaaaaaaaatgtaagaaatcattttttaattcagaaacaagagccagaaccaacattcctactacagattaatactatctatacataatcctgaaatacacctaactaaagagctactgactagcatgcctgccactgtcctctgctatctgctctgttccagtgctctcttgggtaacccaagtctgtttcaaaggctttcacactgtggtaccagagataagaattgwctcaggcttttgcagacaataactactgaccacagtaaggtggatttcccaccccagaagtggtatcaactgaaaagggaactctctttgatcttatccagcgtcttcatgccattttaaattactccactgtggcatcttatttcccaattccacagtcatcttacttgtttattcatttgaacacctgaagttacattatttgaaatgatttcctacctggaaaaatgaaacagggatttaaagcactcatcctgtggtgtacaaaggatagatagagagacttcctcatgtgcaaa

SEQ ID NO: 9 - DNA, 599 bp, Homo sapiens
acatgtaagcatacaatttgtgacttgaaaatgtacagaagcagaagtttacaaattgtgaaaaaaacagaataacatttggcatttggatgaaatgttttccctctgcgtactttcaaacccattaaccccttattttattttaacagcattcttatgatataggtgaatttggtctttagaattactcatattttactgtgggaaatgagcttattacctgcccaaggaatgcagatatggaatttatattcagattaaaattctatcaccatgatgttctttccaagaaaaattgtkgcctgtcaaaaagagaagcaggatggacttcaaccgaaagttggaaataacgctgaaaagaagaaagaataataataattttttaaaagatggcttggcagatgaagataatgcagcattataatcccttggagttggtttggtcaacatttgtaatctcaccccttgcttaagccttggtaaaataacattttatcttatggtattttttacatacattacttgctttcaaaattattctacaccacatagctcaaaaaggagctttaaaatatctaaattgccatggatgatacaaa

SEQ ID NO: 10 - DNA, 599 bp, Homo sapiens
gaattcttgttttggttgtaaggagacttgtaaatggctttcttcatattcttctactttaaaaatagtaggggatgggtgtaaaagtggctaaatgagaacattaaagaaagggctcttaaaggtatttggacctgccaggcaaactctgtaaagttgcagtagagttgttttcaaggtaatagtcagcgtccttctctgaaagctgatttaacttggctagatgataggcatctctttgggtaagttaaagggtctcaagcaataaagtatgttttatcttggttaagctgataattygtcctacttaagcaagtaatgcaaatttccttgcaaagctctgtgctcattagctcataattagggcaataaatctggaatcacaaaacagatcagtgaaaacatcatagtactgtaaatgtgggagtgaggttatcttctcctgtaggaatcagtagagagtttgcaaaaatctattcggattctgactgtgactctacatgtgattatcataaatttaactactaggaagaagagaaggaaaggaaggctgagggccttcctttaacagtccaggtgacaaccaaaattttaaagac

SEQ ID NO: 11 - DNA, 599 bp, Homo sapiens
gtattgactcccaagcttttgctatggaatgtcttaagacatcatgtcatttatctgattccttgtctgtaaaaatctaggaggtggacttaaataatcaccaaggtttccatctggccctaacattccctatttcgtgatggtgtgttcctcatctctctcacatatgcaccttgacatttgcctttatgttaaaaattaagtgttgggttcatatcttcaattcccactctttttacatggcttaaatctgagctatttgtcctcacttctaaatgaatgctccctttagagaaactytgacaccaactgttctgtgttttgaataacttagagagaataagattccaggtcagtaatgagcaacccatgactcagttttgcaatcttcccatattttccatgtgatgaagaacctattttcaggatacaattagaaaattgctctggattattacaaaccttaacatattggtgactaagaagtgcctgcaatttttttcactgacactaaatggataatctaggttgaatgaatatatccactctcacaaaagcccaaataaagctatccccatgttgaattttttaaggtggcc

SEQ ID NO: 12 - DNA, 599 bp, Homo sapiens
taagccttgaggaatgggaaaaaaaggaaatggaatggctttccccattcagagatagcacctccccaccatgctcataactcagacagcactgcactttaaaggtaaggggagggggcacatacaaggaacaggtaagaaaaataagactttcctgcaactctaccattcttcttagaacttctctgaccatgaatatctttctttctctttctagttctctgcctatccatcaaggacaagcttatccccaaattttcccaaggttcccagcccatagcctcctcttagtcccataaycttctggcacctgtctctctacccacttgtatggatgttaatcccaagccatactctaactcttctgctgctttcatgttttgccattatatttcttgtgtttatattttgtttcctaattagattgtaagtaacttgaagtgcctggaagatgtcttttcttttaaaattagttgaccaaagaaagaaaaggaaaaggtaatgcagaaaaagaaagcaaacactgtaactcagaagaatttgccccaacaactcaaatatcagcttcactccaaagctacaccccaaaactaagcagg

SEQ ID NO: 13 - DNA, 599 bp, Homo sapiens
atatcccccactctctgcactcccttctctgcctgcttggaagtcagacagtgaggaaactctatgtatggtatgtggtccatatattaatattttagccactcaggctacagagcagcatggggaagagtggagcatagatctacattccatagcaacttaattcagcatccctttagaactttctaagtaagcagtcagcgtgggttggttaaactgcacaaacctgtaacgaatgagtgatttcaagtacatttttaaaacagtaccataattttctgctgagcttccgaaggcaasgcatcagagaagctgtcaacactaatgctgtctatagaaaatggaaaattaacaaagcaagaagaaatgatcaatttgaacttggtttggctgtgtaaaacttctaatttcagtcatatatattagttgcttaccatttatgcctaattaccatgtagcacaataatgtgtatcattaaacatgtgccaaattaactttacaatattaactttacaatgttaacttagcattattagcttagttcaagtttggacagtttttgtaggttttgactcaggtacatgcttctccctctttt

SEQ ID NO: 14 - DNA, 599 bp, Homo sapiens
atgttgctcatgaccttagttgttcaagtagagtttgttgaatacacaagatgattagcagaggaggaagcattataggattaatatagttcataaacctttaggggtttatagcctctatgagaaataaaccagggcatttttagcccaaatgattagataccaaaacaaatttgtaaaaataacaggtgggaagaaagcatcttgaaacaatatattttttcttattatcttggccactgtatagattgtctggtaccttgagtcttatcttctctgtggtcctgaggcagtccctayatataattagctctggacctggcctgacctccaggagcaatgtctagaatgtgttcattacagtgcctggcacataggaagagtgaattgagtgtttgttaaatgaatacagataagaataatcaaaatgctcattggtgagattgattaaaataaattatatatccatgcactgggatactatgcaactgtgaaaattatgtagttaactatttaataacatggaaagacaatgacagattattaattagaaaaaagttataaatcatatgagtagaatgattccatatgtgaataaa

SEQ ID NO: 15 - DNA, 599 bp, Homo sapiens
taccatgggtgagcgagctttgccttagctaacttcctttactaaccctctcaccccacactaattccattccctacactattgtcatagtaagtggtttctattatatagactttaccctgtgccctgaattttctatgagacaaaatacaactcccattagcttggcgttcaagatcttttagacctatccttttcagctttttcaggctttcctttttatatactccaccagacatacgtctcttgaaacaacaaaataatggtattttccacctcccatttctccctttcctgtcwctcctcactccacaagagtctgccttaagctccagaccctcccctgaatgtaccctcaaatatgggcacccacgacctatatactcctaaatccattgggcatttttcacttagtagcaatgaacacgttgagcacttcctttcctcctaattctttggcttctcctttattaatctccttttctggcgatttttcttctatttatagttcaatattctgcccccaggactctttcctgagcagttttcttttcttcaattctctttacgttctacaaactctctttgggaaatccaca

SEQ ID NO: 16 - DNA, 599 bp, Homo sapiens
tttttcaggctttcctttttatatactccaccagacatacgtctcttgaaacaacaaaataatggtattttccacctcccatttctccctttcctgtctctcctcactccacaagagtctgccttaagctccagaccctcccctgaatgtaccctcaaatatgggcacccacgacctatatactcctaaatccattgggcatttttcacttagtagcaatgaacacgttgagcacttcctttcctcctaattctttggcttctcctttattaatctccttttctggcgatttttcttctmtttatagttcaatattctgcccccaggactctttcctgagcagttttcttttcttcaattctctttacgttctacaaactctctttgggaaatccacactactctttacggttccaattactatctatgtgcaagtgccaaataatcctctatttctaagcttacctctttcctgaaccctatatatacaattgctcataagactttccaacttaagggtcttgtgcatgatataaacatagtgttttcagaagggaattcctcatcctccaaccctccctagtcaacctctttttcat

SEQ ID NO: 17 - DNA, 599 bp, Homo sapiens
aaatccattgggcatttttcacttagtagcaatgaacacgttgagcacttcctttcctcctaattctttggcttctcctttattaatctccttttctggcgatttttcttctatttatagttcaatattctgcccccaggactctttcctgagcagttttcttttcttcaattctctttacgttctacaaactctctttgggaaatccacactactctttacggttccaattactatctatgtgcaagtgccaaataatcctctatttctaagcttacctctttcctgaaccctatatayacaattgctcataagactttccaacttaagggtcttgtgcatgatataaacatagtgttttcagaagggaattcctcatcctccaaccctccctagtcaacctctttttcattaaagttgcacacctgtataaatgacaccactcacccaatttcttcagtgagaattgaggagatatatttgacctctcccactatttttgacccctacaactagttaccatatcttgttgattatatctcacaaatatctctaaaattcatcacataatgacaatccattgcagccatcttacccca

SEQ ID NO: 18 - DNA, 599 bp, Homo sapiens
ttacgttctacaaactctctttgggaaatccacactactctttacggttccaattactatctatgtgcaagtgccaaataatcctctatttctaagcttacctctttcctgaaccctatatatacaattgctcataagactttccaacttaagggtcttgtgcatgatataaacatagtgttttcagaagggaattcctcatcctccaaccctccctagtcaacctctttttcattaaagttgcacacctgtataaatgacaccactcacccaatttcttcagtgagaattgaggagatrtatttgacctctcccactatttttgacccctacaactagttaccatatcttgttgattatatctcacaaatatctctaaaattcatcacataatgacaatccattgcagccatcttaccccagactgccatcatctcttacctaaattaattaatcacttggctccaatgttgtcccacatgaacccatcctgctctaggctcatctatttttcttcaaatctgataatttaaccccctaacttaaaacccttcaagataaagttcaattatcttgaactttgattatcacttttaagg

SEQ ID NO: 19 - DNA, 599 bp, Homo sapiens
ttcattaaagttgcacacctgtataaatgacaccactcacccaatttcttcagtgagaattgaggagatatatttgacctctcccactatttttgacccctacaactagttaccatatcttgttgattatatctcacaaatatctctaaaattcatcacataatgacaatccattgcagccatcttaccccagactgccatcatctcttacctaaattaattaatcacttggctccaatgttgtcccacatgaacccatcctgctctaggctcatctatttttcttcaaatctgataatwtaaccccctaacttaaaacccttcaagataaagttcaattatcttgaactttgattatcacttttaaggctttctaagatctagttctggcccccactaccagcccagatgatgtaccatgtgtactttcacactatatggtccagcttgtatctggacctcttgtgtctctctcttttttttttttttctttttgagatggcgtcttgctctgttgcccaggctggagtgcagtggcgcaatctcggctcactgcaagctccgcctcccaggttcacgccattctcctgcttcagcct

SEQ ID NO: 20 - DNA, 599 bp, Homo sapiens
agaaatcatttgtatttttatatcttgttttcaatatttaaatgacacatgctatttccattcccaaattaattgataaatacatgaataaataaaatagctgtgccatatagttatccttgatatcactctagatgaggaaactgaggctggaaagattaaacagcttaagtaatattaacaaagcaaataactcttgggacctccttgctctgtgtatgtcaaagctcatgctctctttcaactccattacatctctttgaatcagatagtaagatgaaacctcttctaggaagtaargacttcctggccccaatcaattctttttacttgccacctgcttgtgaatattaatattgctttcgctggattttaaaaagtagactcctaggtaaacagcaaacaagagaggcagaggccagaatgctcagaaaaaaggatacaaactggcgcaataaggattatatggtctgaagcagaggtatgtggaagctgaggtgggaaagtgatggtaaagcaaaccagacccaaggatattggtttatcttatggcaatacttaacccatggaatgagaacatttgtatgaattatccatgc

SEQ ID NO: 21 - DNA, 599 bp, Homo sapiens
ttcatctttagttttatccaaattagattggctaattttcatctgagttcttcagacatcatatcttgtgccgaatatcttagctctcaaattcctaacttcctattttagaaaattcagaccaaaatcaattctctagttttccaaacacttgttactgattttctttccatacacttaataatgtagaggttcaacaacttagtgcgttgcatcacatattaattgtcttctatatcatctcattgaaatgcatccaggacatactattattcttcccacctctattcattttttttkgttttatttggcaaggaaataaggccctatagctactttattcaaaatcattatctctgcaacataatttcttttgtttatttttcttattttagtatttataaattctcttactgttccacaagttcagtggggcagtggtctaacttttccaactatcaaatcactttaacacaaacttactttctcctacaactgaattggctatctttactgaaaaattataaatatgaaatcatataaaaacataaaaaataataatttaaatgatattttataattatatattataataattt

SEQ ID NO: 22 - DNA, 599 bp, Homo sapiens
aataatgtagaggttcaacaacttagtgcgttgcatcacatattaattgtcttctatatcatctcattgaaatgcatccaggacatactattattcttcccacctctattcattttttttggttttatttggcaaggaaataaggccctatagctactttattcaaaatcattatctctgcaacataatttcttttgtttatttttcttattttagtatttataaattctcttactgttccacaagttcagtggggcagtggtctaacttttccaactatcaaatcactttaacacaaayttactttctcctacaactgaattggctatctttactgaaaaattataaatatgaaatcatataaaaacataaaaaataataatttaaatgatattttataattatatattataataatttataatataaataatttatataccttatttcaatgtacatataaatctttgtatttgaatccctggtccatcacttgttaactccacagctttaggcaaggccgttaaaccctttgaagtctcttgttattccatctagaaaatatgggtgacaatggaatttccatcatagctttgaag

SEQ ID NO: 23 - DNA, 599 bp, Homo sapiens
ctttaggcaaggccgttaaaccctttgaagtctcttgttattccatctagaaaatatgggtgacaatggaatttccatcatagctttgaagatgaaataagaaaaacatggaaattattatagtgactaccacataacaaggcaataaaaggtagctgtggttattgttataaagcaggagtatttatatagttcaatgtaattattaggatagaccatagatctgcttttgagcccttgaaatgtagcccaaattgagatatgctataaatgtaaaatacacactgggtttcaaagacytagtataaaaaacaaagaaggtaaagtatatcactaataagtttttacatgcatacatgttgaaatgatattttagatatattggattaaattaaatatgttaaaattaattttgtatgttttaaatatttttaaaatggccactagaaaaattaattacacatgcagcttgtatttgtggtacacattatatttctactgtacagtactgctataaataataataattataaacccatgagtgggtttagttttacttagaaatcttgtcataaattttctctcatgtgaaatgttgt

SEQ ID NO: 24 - DNA, 599 bp, Homo sapiens
gttcaatgtaattattaggatagaccatagatctgcttttgagcccttgaaatgtagcccaaattgagatatgctataaatgtaaaatacacactgggtttcaaagacctagtataaaaaacaaagaaggtaaagtatatcactaataagtttttacatgcatacatgttgaaatgatattttagatatattggattaaattaaatatgttaaaattaattttgtatgttttaaatatttttaaaatggccactagaaaaattaattacacatgcagcttgtatttgtggtacacattayatttctactgtacagtactgctataaataataataattataaacccatgagtgggtttagttttacttagaaatcttgtcataaattttctctcatgtgaaatgttgtcacccataatgaactcttataaattcttatatagacatgtaaaatattttgaaatattttattataggatatatagaaaatattctcaggattattaatttgtaatgacatattaatatattataatttgatataaaggctctttttatatcatatttgcaagatgtcttccttatgtaggctgtgaaaaa

SEQ ID NO: 25 - DNA, 599 bp, Homo sapiens
tatatagacatgtaaaatattttgaaatattttattataggatatatagaaaatattctcaggattattaatttgtaatgacatattaatatattataatttgatataaaggctctttttatatcatatttgcaagatgtcttccttatgtaggctgtgaaaaaaataaagatttacttgggtatcatatatttatacacccagttaatttacaaatgtgagggtaactgaagacctgtatgataatagatgggaaaacttagttaattttgctaaaaggaatgcagtttaccagaagaycagtaatagattgtggttaaaaagtggtcctagagaagcctgtgtaagtaaaagacattgtctaaaagctgtgtggggatatagggttgttctataactgtacatcctgcctctcagtgtgaccttgagcatcatggactatgacgaaaccctagtttctagccatgtgaccaactagttgttaagaaaacaggcttgtataaataaattcacccaaagattcatgctgaaggcctcagattccatttctataaattgagatgctctctgataacctccagctcaaaaggagatgataa

SEQ ID NO: 26 - DNA, 599 bp, Homo sapiens
ctgaagacctgtatgataatagatgggaaaacttagttaattttgctaaaaggaatgcagtttaccagaagatcagtaatagattgtggttaaaaagtggtcctagagaagcctgtgtaagtaaaagacattgtctaaaagctgtgtggggatatagggttgttctataactgtacatcctgcctctcagtgtgaccttgagcatcatggactatgacgaaaccctagtttctagccatgtgaccaactagttgttaagaaaacaggcttgtataaataaattcacccaaagattcatgstgaaggcctcagattccatttctataaattgagatgctctctgataacctccagctcaaaaggagatgataatacatgacacattcaaacaggtaagtggaaatatatccctactttttacatttgtatatgccacatttataaagagaataactttaagtattactttaccctatacctcacaaaaaaaaaaacaagaaactgtctgaacatttatgacagaaaagacatatgcctagattcctcagacccctgctgaggtattcagggactctctggacaaagctgtgctcagcgga

SEQ ID NO: 27 - DNA, 599 bp, Homo sapiens
tagggttgttctataactgtacatcctgcctctcagtgtgaccttgagcatcatggactatgacgaaaccctagtttctagccatgtgaccaactagttgttaagaaaacaggcttgtataaataaattcacccaaagattcatgctgaaggcctcagattccatttctataaattgagatgctctctgataacctccagctcaaaaggagatgataatacatgacacattcaaacaggtaagtggaaatatatccctactttttacatttgtatatgccacatttataaagagaataaytttaagtattactttaccctatacctcacaaaaaaaaaaacaagaaactgtctgaacatttatgacagaaaagacatatgcctagattcctcagacccctgctgaggtattcagggactctctggacaaagctgtgctcagcggaagtttgggctctctggttctggtctttgtttctgtttctaatacacattcatactaaaaggaactgaaaattgaggtacagttctcttaaaattactctgtaccctgatttccacctaagtctttagttgtctttctgaaaacttcccagtaca

SEQ ID NO: 28 - DNA, 599 bp, Homo sapiens
tcacccaaagattcatgctgaaggcctcagattccatttctataaattgagatgctctctgataacctccagctcaaaaggagatgataatacatgacacattcaaacaggtaagtggaaatatatccctactttttacatttgtatatgccacatttataaagagaataactttaagtattactttaccctatacctcacaaaaaaaaaaacaagaaactgtctgaacatttatgacagaaaagacatatgcctagattcctcagacccctgctgaggtattcagggactctctggacmaagctgtgctcagcggaagtttgggctctctggttctggtctttgtttctgtttctaatacacattcatactaaaaggaactgaaaattgaggtacagttctcttaaaattactctgtaccctgatttccacctaagtctttagttgtctttctgaaaacttcccagtacaattttagaatctctcttcaatacccctgtttccatgagtctattctttaccacccaaaccttctcctactaggagtcccaggtaacttgtacctctggtttttttgtttgtttttgttgtttttttta

SEQ ID NO: 29 - DNA, 599 bp, Homo sapiens
tcaaaaggagatgataatacatgacacattcaaacaggtaagtggaaatatatccctactttttacatttgtatatgccacatttataaagagaataactttaagtattactttaccctatacctcacaaaaaaaaaaacaagaaactgtctgaacatttatgacagaaaagacatatgcctagattcctcagacccctgctgaggtattcagggactctctggacaaagctgtgctcagcggaagtttgggctctctggttctggtctttgtttctgtttctaatacacattcatactmaaaggaactgaaaattgaggtacagttctcttaaaattactctgtaccctgatttccacctaagtctttagttgtctttctgaaaacttcccagtacaattttagaatctctcttcaatacccctgtttccatgagtctattctttaccacccaaaccttctcctactaggagtcccaggtaacttgtacctctggtttttttgtttgtttttgttgttttttttagagatggggtaccactctgtctcccagactggagtgcagtggcacaatcttagctcactgtagcctcaaattc

SEQ ID NO: 30 - DNA, 599 bp, Homo sapiens
ataactttaagtattactttaccctatacctcacaaaaaaaaaaacaagaaactgtctgaacatttatgacagaaaagacatatgcctagattcctcagacccctgctgaggtattcagggactctctggacaaagctgtgctcagcggaagtttgggctctctggttctggtctttgtttctgtttctaatacacattcatactaaaaggaactgaaaattgaggtacagttctcttaaaattactctgtaccctgatttccacctaagtctttagttgtctttctgaaaacttcccartacaattttagaatctctcttcaatacccctgtttccatgagtctattctttaccacccaaaccttctcctactaggagtcccaggtaacttgtacctctggtttttttgtttgtttttgttgttttttttagagatggggtaccactctgtctcccagactggagtgcagtggcacaatcttagctcactgtagcctcaaattcccagatgaaagcgattctcctgcctcagcctctgctgtagctaggactacaggtgagcaccactgcacctggctaatttttaaaattgtttgta

SEQ ID NO: 31 - DNA, 599 bp, Homo sapiens
tgcaactctactcaactctccaatttcatctcttgttcccatcttacactcaagccatactgaacactcaattctctgaatggaaccattcatatttattcactctctgtttctgtcattgtttctcttggactcttcttgtctttccctgtctgccccactgtctcttccaggactttgtagatgtctttcctctgcttagaacatgttttccattttcccatttcatctttccctctttgtgaaatttacttttgtttatctttttgaactcagcttagttgtgacttctaccaggayatatttttcttagtctcaggctgaattaggttccccacccatttgtttccacagtatatttctttcatatttatggtaataattaccgtgttttatgatgcctaattatttgtttgcttcctcactgtaagatttttgtatccttgaatacagggattgtgtcttattcaatattatgtgctaagcacctagaccagcacattggaagtaccgaataaatgaatgaacttcctacagtatttagtcaaggggcttgcatgcaataaatactctacttcctaaattttagataatttttt

SEQ ID NO: 32 - DNA, 599 bp, Homo sapiens
ttcatatttattcactctctgtttctgtcattgtttctcttggactcttcttgtctttccctgtctgccccactgtctcttccaggactttgtagatgtctttcctctgcttagaacatgttttccattttcccatttcatctttccctctttgtgaaatttacttttgtttatctttttgaactcagcttagttgtgacttctaccaggacatatttttcttagtctcaggctgaattaggttccccacccatttgtttccacagtatatttctttcatatttatggtaataattaccrtgttttatgatgcctaattatttgtttgcttcctcactgtaagatttttgtatccttgaatacagggattgtgtcttattcaatattatgtgctaagcacctagaccagcacattggaagtaccgaataaatgaatgaacttcctacagtatttagtcaaggggcttgcatgcaataaatactctacttcctaaattttagataattttttttgtggacactgtaacaggaaccagtcattcagaaagaaagaggtagtatcgaaagaaaggacaaaacttatgatctacccaattttc

SEQ ID NO: 33 - DNA, 599 bp, Homo sapiens
ttttcagggttctcaaaagaaaaaaagcaaaaaccttatatctttaaaggataatattttactcccttcaccttgaacttaggtttaaattaaaattaggttgaatttagatttaaatttaggttttaaaatgtgtacattctttcataatcttgagatactctgttttatattactcaataaaatgataaggttattttttacacttaggcccattatagttttatagtaaaatattcaaaggccttgctgtcatgaaaggttttgctacacataaatcaggcctgcttggtacatagwgataaatgtggtaagataagtcattcactcttactgtcattcagatggccaatgatggagctgtccttgtttctccaaataagttttattatggagttctgccataatagtctggacaaacagaatgaatttaggtctcatagaccaaaacaaatttagaagtgtaaaacagtcactgggccaattctcccaactatggcatttgtaatttacatggtctcaaaatattgaaaattagtcttacaaataaaaaaaaagtacaaaaaaaaggctttgcttctaagaaatacgagggttac

SEQ ID NO: 34 - DNA, 599 bp, Homo sapiens
tgttttctatagattagaaactatgaaccaggataaattaatcattcaaaatatgttaacacaaatgggcatttagttaaagctgagagatatcatattgaatatggtggctagtctctcaatatgatgcttaatcataatttttaagagtcaaaaagactttttttctaattagagcagacaatgtgtcagcatactgtagttcgaattgactatattattgtgcactcatttttggaatttcaagtaaaaacaagaaaaagcataagggatctaatacagagctcatctgtatttcaraagaattaggtcatgacccatttcatatcttaaagacccaagaaagctacttgaattcttcaaggcaaataaagaataaattctttcctttacccttgcctgtagcagaatttttctcatgcttgttatgtgatcaagtgatcactttcttagctataatcagacttgtcaagacattaaagaagaaagcagcagactctgggcttctacttgcagcttggaaaacgtattagtgttatggtatagccaaactcccatatttgttaggatgactaaaaagtaatttggctaagagcttg

SEQ ID NO: 35 - DNA, 599 bp, Homo sapiens
agagtaaatcatttttacagggcatactgaacaagtaaagttattctaagaaatgaaagctttaggtttccaaacagtactggcacaagtgcaactggagaaagcaacaataaacaacaagtaataagttatgttctttcctgagaacactgtttttaatcaactgattcgccttgtctgagttgttaccctatccttaattaaacatccttgggcagtatttctactcaaaaaacaactgttttaagttctttgtctgcactatgaatgtcagtgtctaagggctaacagattagtccrtagcaacttagaaaaaagggatgaatagggaacagcattggagagtatatgtcaaatgaattagggcagtagtttagtgagccaatgtgccaatttagaaatggattcttcttcctgctgaagagctctttttaaaataaattacaatcataaagctgccacagtttactgtgcatagacatgttcagaattggctcttcttcatgagggctgcttggtgcaggtatttaagctactgccaataaggctaacagctcatcaaatagaaaatacgctgcaggaaaatacatgggttaaga

SEQ ID NO: 36 - DNA, 599 bp, Homo sapiens
agattctgattcaagctttttattaagatagagatagcaaaatagaactaaggggatgcttctggtaggttgcttatggatgccactattttcaaagagatgacatttaaactaacatctgaaagataataaggcaactatgccaagatcttgggaaaacgctgaaggtgttgacttctaggatcatccattagttcaaaaacagtaggaaagaataaagaaacctcgggttgcaaagaacccagagtgaggcgtaaagtagtagaagatcagacagtagaagtgggcagaaccaccaawggccatgattagtagtttgattttattataaaagcaatggaaaaccattaaaatattttaagaagaggagtgacatggtttaaatcagattttaaagtaacattctggttgctatctggagaatagattgggaagcaggagtatagtggctgagagcagagaccctagattcagacagaccagagcttatatctcagctttcatgagtatattggaagttggataaaatgtaaacatatagttatcaaggtatgattttttttgctatatcagatcataatttttaaagtactctcaca

SEQ ID NO: 37 - DNA, 599 bp, Homo sapiens
aaatggatgaaggattgagggaaaaagaattataagaaagacaagaaagagcagaccacaacactcaaaagaagaagggaagataatttaaataaaacaaaatagaaactggtgtattataaaagagagtaagtgatgacaaatgctacagtacattagaaaatactttagcttatgaaatcactgatcagttgtcaatttaaagaaacgatgtgattgtgataataaattccttagtaagagacaacaatgcgtttgagggtacactactctcatgacaaattaagagactatttctawgagatttaaaactagagcaactaacattatgttgtttctttaaacaatatggtcaaagatgagctccatcttgatccaagccacatggtaattttttttttttatttttaagaaatttgaagatatgaagaagaccatcttgtcttaccagtttctctgagggcatgtagcatataccttaaaaatgcatgttagtttgaaattctattaaagataaatgtggaaatatatttaaacataggatgagtcataatactttacaggaattttctcataataggtgaaggcataactgaaca

SEQ ID NO: 38 - DNA, 599 bp, Homo sapiens
tctccatttgaaaagccactccttacttgctaatgaactttggttaagactgtgtactgggccataggactcggaatgacaatgtagcccaaaccgtgcatcatgaactaggtgttatctaattcaacatatcaaaaatgtacacaacagcatttccttggtatattttccttccctgcagccttcttatgctagttgaggaagcccaagtatactgtatgagcaagtagctcagaggtccctaatacctgctactactgcttctcaatctttttgcttcaacccgtatgtatggcctcmtggggtattctcagtgactagttgatgaggatgaaacagtgtggatctggtttgtaaatagaatgtctggaattcaataccagctatgactatggtgtttacaggtccacttaagggagagggccctgaaatacagtggctatcccaccagcagccagaatttcattcagctagtacatttaactgcacactttgcatggaagaagagatagttgaggtaatgacatatggcatggccatatggtcaaggacttcaaagaacaaaattggacgactggtgacagaaagtctagggaaga

SEQ ID NO: 39 - DNA, 599 bp, Homo sapiens
tacgtgattctaatgcaatttcctgtgggtatgatttcttagcagaaagagctggatatggaggaagtgtccctaaaatcatttatccaaaaaatcattcaattgaagtacagcttggtgagtaaaattattgaagccattgaaatcaccaggggaagagctcattatgtttgcatattctggtgaatattttgaatgttaaggatgaagataaatcctatacacacccagtttccagctttggatatacgtgagctcatggggagaggaatcaaaataaaacaccagagagccgaagcrtggaaaagttgtggtagcagagaagtctggcaatgaggactatgggcccaaaatgattattataaatctgtttatgcaaaggcaatgaaaatgcaaataattcttcagacaatacataatataatataaaactactattaaataatgttgaccaggagttctggattatattacctcacaatgcaagatatattacaggagtgaaaaaaattatgatgttatattccttaatctatatggaaaaggatcaataagcattgcctcaatttgtgatctaagtagataaaaaggcatcaaat

SEQ ID NO: 40 - DNA, 599 bp, Homo sapiens
gcacagaaacccaggatggcagcatagagaggggaggaaatcaccctttctctgtcactctgtttcccccaccaagattgacttggagccaagagaaacttctctttgcagggaaaaggtaagcagaaggcctctgccaccttcattattaccacagacacctgcagttcttgctacagaagaaagctgcagtcctcacaggtcctgagcccagtttggggagcagcctggagttctcatggctatattgctccagtgcaggaaactacattgtgcatacccttatcccctatgacccaygctgctacatcatgccactgtcttggaattatagctactgctagagtgagtcctgttctgggggccagtagccactgcatctctccatccccaatgctttcccgtcatttcaccatgttcatacaggtggctacaactccaaaatcctggttacttagagtatgggccctatgaaattactgtgatcctggttcccaaatgcacatggtgccctgcttcctgtatggacaggcagtcctgcacaactggggaagctttccctagccagcagacctactctgctcaccctcatacccatg

SEQ ID NO: 41 - DNA, 599 bp, Homo sapiens
atagaattatagtccaagcaaggcaaagtcagtttccaatgagccaatgtgcccttgtcacaggccaatttataacttaatgattaaaggtttttaatactaaaaattagctgtaaaccctcatcacttttttccaagaccctggcctgagggaattaggcatagctcaaccttctgaagctgtgggttgttgacactgagacttagtaagcagtcagtgggggctggaagggagtcagccctgagagccagccggcaggggcgagagagggagccagagggtgtcaggaggcctgtggycttaggatggcatggggagcagggtgggttaggaggtgctgtgccctcgttcacaggcgatgggtggtacccagtgtgggatggactttcaggtgctaaggaacccactcctgtctttgaagagtttatgttccaaggtgacctcacattacacatttgtttagcatcctatggaggcctcgacttgacattggtccactctttatttaacatttgctttttaaaatttttatttcggtaaactatatgaacataaaattcaccattttaacaatttttaagtggcattaagtacattc

SEQ ID NO: 42 - DNA, 599 bp, Homo sapiens
taaaaagtatttttgagttgagatcaataaactggtttgaagtctaaggtttcaaacataagtaagacatgaatcttgaaaataactcaattaagaaataagtagaaaagatttcaacataaggcaataaaagataccctccttccacagcgaaatatcaccttcaaccaaagtttctttttcttgaatcaattttattatgtttaattttcatatggtgtaggaagggcaagggaaatggggcatgggaggtcagagagaactttctggagaatgtgatccccacataaaggaatgtcrgctggaaacggtggatggggtggaggtggatgtggccgaagaccttgtctcacacgaagaagaagcataaaatcatgagaagtgttcagagccccacaaagacttcaatttctcaaaacatgaagtcaagaatgaagaggggactagaaggtggaggttggggtgaagaactcaagaacgaggagagggagaagggtgtgggagccttgaacaggcacagctggagaaagacttagtggtattacatttttaaagatttctctgctcataaatacttgaaaaaaaacttgaaaatgcaa

SEQ ID NO: 43 - DNA, 599 bp, Homo sapiens
tgttcatttcaaaacttgtatatttttaagtctaactttacaaagaagaggagataataacaaggaccctgataaattaactatgtatgtgtggggtgtaagagacactaaaacacaattttacacaaaaatcaaccctgatggtaccagtcaaataactgggtctttttgtgaaaaagaaatgaaaatacctcccagtagccacaaaatactgtaatcttgtggttctaagaacctttagtgaataacagtaagacatggttggattttgtgttgatttcaggttacatttatttcagytaaagaaaaggtgtaaacttgtgagatatatcatttctccagacttgagcacatggagaggattacctgcatgtgtgtttggtgagaggaagggtacaatagcctagagaccatgtctgagatgacatgtcttttagagaagctgaattagcatttgtgatcaatggttacttccaatcaccactttacaagaaaaagtgattttagcaccttcgtttctgagaaaggcaatgttctcagaaaggaaagtttttaactctgttatttgctgctctcaggagatacttgtggttttgaga

SEQ ID NO: 44 - DNA, 599 bp, Homo sapiens
ttgcagtaagccaagatcacaccactgcactccaactgggacagcaagagtgaaactccatctcaaaaaaaaaaaaaaaaaaaatatatatatatatatatagaataacatttgtaaggttatagagcaaaatgatgacaaaggtttgagtggtgggattacaagtaattttgatttctctcttttttggttatgttttctatgactactattattgctttaattagggttattttaaaatcattctctaatctagctccttctagatatgcatgtttaagccttaaactcttctctacrcctttgtgtcccaaactgcaccgctatagtgcttagctacaatcccaggtttacaagaagtactgaactcaaaccagcaaacatgggtgggctccactcagggtcctgacctaaggtcatcgaacacaaatggaggaggcagattccttatcaagagtacaatccaagacaaactgacataagtgctctataaatgtgtaaccaggatgcaggactcaaagggaagtcccaagccaggaggaatgcacagagccctcccaaaccaagtgacatcggagaatgagaaggtttcccctggc

SEQ ID NO: 45 - DNA, 599 bp, Homo sapiens
ctgatttcttaatgtacacggcatatttgggaaaaatagaagatttgggcccgagtgtcaagtatgaggataaaatgcatgtgttgaagaagaaatctggggaagtcccagcccttactgtacctttgtgtgaaaagaaaggtacctcctttgcagagaaaagtacctccttctctgagcagactcaagctcagcccaggtcgtgggacgaacttagtgattggaggatgggttgggttttagttgccacttgctccatcagctggacacactcctgcagtgtacaaactgaacaacggytcctaccacaatgctgtgaggtaaggatacagagctcaaagaaggtaaataatttgcccatattttgagcaaggacatgcatccagagtgaagactcttaagcaatgaatgtggacatgattccatgggctgtgggaaccattgctggttattgaggaggaaatgaaattgaatgcactaagactagggcacacatggagaataaacaggaagctattgaacgctcctggtgagacatgatgagacctgaatttggacagtggtagtgagtaatgaaagaagtgaagaagtgtgatgga

SEQ ID NO: 46 - DNA, 599 bp, Homo sapiens
ccatcggcatttgctgatagttgaaattatgagaatttatgagagtctctagaaagagaaggaaagacagatccttagaaaatgcctacatttaagaggaatcagtgaatgaacccaaaaatagcaatcagagtgagggaagggacacaaagaagaaagtagggtgtcatggaggccaagagtagagtgtcaaagaggaagtggtcaaagtgtcaaatggcaccagtgtagaacagatgagagctgagaagatttcattagcaagtcagtcagaaggcaatccattaccttcaatgagcmgttcaaaccccaaggttccagggggtaggtgtgtggtgggggcggtgaaggctggagtagagctcttttgtaagaatttgggtagagaaaggaaggagagaggcagggcagtggtttcataggaaagtgaagaccagggaaggctttagttataggggcatgtgtgtctagaacatgcttagagagcgagtgatacagacatcactatctgaagctgatagatacagacgtcagaactgagacatagaagaaccctttgaaaggtgagactgcattgggagctgggaggattgagaaat

SEQ ID NO: 47 - DNA, 599 bp, Homo sapiens
gtttgttcacattttctagaaattgatataaatggaataatacagcatgtgcttgtttctctctggcttcttctattctgcgtaattattgtgaaagtcatccatatgattgcatttatcagtacattcatactattgcatttatcaatatgtcattcttgttgattgtttatcatattcccctattatcttcttaacatctatagaaacttagtggtgtcaactctctttttcttgatattagtaatttgtgtcttctttcttttttcctcagtcagtgtgactagagagttatcaacyttattagtcttctcaacaaaccagcttttggcatcattgatttttctttattgtttttctgttccatctcactgttttctgcattgatttgtattatttcattttcttctgttttctgtgctttctttgctcttctttttctagttttttaaggtggtaaccaatattgatttatgacttttattattttctaatgtatgcctttagtgttgtaaatttccctctttagtggcatatcccaaattttgatatgtagtgtttttgtttccatttagttcacaatactttctaactgccct

SEQ ID NO: 48 - DNA, 599 bp, Homo sapiens
ttattaagtaaaaaattctaaggtgactttttctttcagtcatttaaagattttattctgcttgcattgtttctgatgagaaatctgatgtcaccctctccctagttcctctatagtaacatggttttttcttttctcacttttaagagtttttctttatcactatttttagtgtttgagtttctgggtacttcagggttttatacttttcatcaaatttgcaatattttggcgttatttcttcacataactttttttctgtccttttgttcactcctttcctcctggaacttcaattayacttacattagatgactcgaaatttccccacaattcacagatgctgtatttttttcagatctgttttctttctgtattttattttgcgtagtttctattccatacaatatatttttcatctgaaatgtagcttttatctgtagatgttttatttaggtctttttaaaatctgccatatctctgcttaacacaatatttcatataggtttttttttcacatatggaatttggatataatagctgttttcatgtccttttctacttattctatttatctatgttaattctttgctagtttt

SEQ ID NO: 49 - DNA, 599 bp, Homo sapiens
gaagcaaaaactcaaccttattttatggttacaccatatcatgtgcattcagatctttcatgattccataatgggtaaaaaaccttcctgtgttcagaagttaaattggctgttttttattttactgaggcagttagccttaataattggctcctatttgtctgaatatgaactgtagggatcaaagactttgctgaattcattctctttcttgtccactctttaagaaattagaaattaaacaaggcatgaaagctagtgtgtttcactcttcccccttactcctattccaaagttcasaaaaagtctatgtttagttaagagttaacagaggtgcttgattttgagtttgtggaatagaagttatgttaaagccacatgttcacccggaagaaaaaaaataattttggtaaaaaattagatttttatattctctctctctctctctctctcacacacacacacaattgccccttccttcctcatcattcttttgcttattaagcaaaaaaagtttactcaattttttctataaaacacatttagatctttccacattttaacaggattcacatgtcccccaccagccttgaatagtt

SEQ ID NO: 50 - DNA, 599 bp, Homo sapiens
ctggagcaccgtggtgcagtcttggctcactgcaacctttgactcccgggttcaagcaattctcgtgcctcagcctcctgagtagcttggattagaggtgtgcaccatcacacgcagcaaatttttgtattttagtagagacggggtttcaccatgttggccaggatgttgggattacaggcgtgagctaccatgccctgccagaaggtttgtttttattttaaacacaattgtgctgggtgtgataggatgggtatatgatagagcagaaaatcactagtatttcatcaatatggatarcatcctccataggttactgatttaatattgacaacaatacccttcacacgagagagaggttagagaatttgcccaaagtcaagcagctgggaagaggaaaactaggctgtgctctccctaaatctcatgctctattatattagggaagactctggcagatggcacatcctgattatttgaaagtcaccaatatttttagaaattgcatagataattaaggttagtttatccagaattctaataattgcagcacatgtccataaatctctattacaaccacctgagataggccatctcgg

SEQ ID NO: 51 - DNA, 599 bp, Homo sapiens
cgccctgcctaactagccctttcctttctctttcttggaactggactcttggttgctgttagatttttgttctagaaccagagggatcttttccaccaacctgtagtaggaccctactgcacatgcacgcgcatgcaagtgcacgcacacacacacactcgtgcacacacacatgcatgctcccacaatgttggcatcgccactgttgtaagactcctgcattgtatcctcccaaccagactgcatttgcccttggacatggatgtcagcctggctcaaagtcatcacccaaatccttgyggggctctcccttgcagttgtctgcctctgcactcccagaaaaccaggaagtatggaggagtgggcagagaaatataaacccttgtgattataggacaaatattttaaaggacatagaggaagaattctcctagaggaaaaacaggtatccgaaaactgaagacaccccagatacacttgagctatgcggccacatctccaaacacagaggcacccaagtagaaaagtaacttggaatcaatctcctcacctaaacaacgcattcaagaacagagagaatcccagatcctgctggggat

SEQ ID NO: 52 - DNA, 599 bp, Homo sapiens
tccttagcacgcttggaataacatagcagcagcagcagcagtcgacacttactaagactgctatgtgccagaccctgagacaagcactttccacacaccacatcctgccattcttatgatgatagtgctgtgaagtagggatgaaaccaagtccttgctgactccaatcttgtacttccaaccaatgcttgtgagggccccaggccccctacagcaagactaaacatggacatatgtgtggctgggctgagtctgtgggattggctctggagttgggtgtgtctgagccctgggtagaargggatgctatcctaatgaaaaaacacagaataaagatagtgtccaccaagatgtaactgagatttaaagaagacttgataacttatcagttgggtgggtagtcttgaatttcaacaactgcagatcctatctaagaccacttttgtcttgtgacaacttagttaaacatgactttagtgtggatatcagtggccaattttgagcccattctatgattggaacaaaggcttccctgtcataggtgagtgacaactatctggtctggtggtacaggggtaaaagaatttactaagacagtt

SEQ ID NO: 53 - DNA, 599 bp, Homo sapiens
ccagaccctgagacaagcactttccacacaccacatcctgccattcttatgatgatagtgctgtgaagtagggatgaaaccaagtccttgctgactccaatcttgtacttccaaccaatgcttgtgagggccccaggccccctacagcaagactaaacatggacatatgtgtggctgggctgagtctgtgggattggctctggagttgggtgtgtctgagccctgggtagaaagggatgctatcctaatgaaaaaacacagaataaagatagtgtccaccaagatgtaactgagatttaragaagacttgataacttatcagttgggtgggtagtcttgaatttcaacaactgcagatcctatctaagaccacttttgtcttgtgacaacttagttaaacatgactttagtgtggatatcagtggccaattttgagcccattctatgattggaacaaaggcttccctgtcataggtgagtgacaactatctggtctggtggtacaggggtaaaagaatttactaagacagttgtagataaagaaaggcagatttattagagaaagtatgaaaatacattacaaggttgcaatgggcagc

SEQ ID NO: 54 - DNA, 599 bp, Homo sapiens
tatcagatttaagaatgctttcgtcataagggtggaactagaaatcagaggtgagtgaattagtcctggatctgacccagcgaccagaggcacaaaccatcactggcagactgagataaggggaggatgaaagtggcagcaaacagcctgaagacaaagaaaatggaaaaacctaaaggatccatgtttacattagacctctaatttcctgaaaatactcccttaatgaaagcaggaaccaaacccactttaagtaattcatttggttgctatgattgaggaatgtgttagtttcaaaartcttaatgtagattatattttgaaaaggttattcactttgcataggggctagttttctagataattcctctaaagggtgatttttctggtgtcttgagagttggtgtgtacgttcgtgatctggcacagactagtcagggtgcacaaagcagctcagatttccagaaaccactacttaagaaaaaaaggtgaaatgaaaagaaaataattttgcacattacaaccccaaatcagacaaggttttgctcaagaagagaaaaatgatgagggaattcctcactaaagtctcggtctttacc

SEQ ID NO: 55 - DNA, 599 bp, Homo sapiens
agaatatctatgcccaccagattacataaaaagtatgagatgaggttcgggaaataagataaagatttataaactggaattcagaatgtggtttatggaaagatttaaggtaaattagcatatctcagctcagggacagacaagtcttagcaggactcctcctatcaaagaaatcttatttccattttcttcccatttttctgtgctcaagacatgattaactaactgcagagacatgccaaagacaatcaaatccttttttatgtgaatatcagatttaagaatgctttcgtcataagkgtggaactagaaatcagaggtgagtgaattagtcctggatctgacccagcgaccagaggcacaaaccatcactggcagactgagataaggggaggatgaaagtggcagcaaacagcctgaagacaaagaaaatggaaaaacctaaaggatccatgtttacattagacctctaatttcctgaaaatactcccttaatgaaagcaggaaccaaacccactttaagtaattcatttggttgctatgattgaggaatgtgttagtttcaaaagtcttaatgtagattatattttgaaaaggtt

SEQ ID NO: 56 - DNA, 599 bp, Homo sapiens
cttgacaggttatttttgtgatgtctggaatatagacaagtgaaggcattgagtcagcaggtggacatgagaacctgaagttcaggggaaaagtgtggacggcaggtgtaactgcaagagtgtaatcagtatagagatggtgtttcaaaccagttaactggatgacatcatgtggggagtgagtgtggacagagaagaaaagtgcttcaaggactgaaacttgaggtggtggagagaagaggagatgtgaagcagtagcctgtgggtcctgaagaaagatgttggagaaattgttccacyttgacagaggctgcttatagctcaaggtaaggggaagacgcaggactgaggattcctaagcaacatggtggtaattgacgatattgataacagcataaagacatcataatttaaactaattattaacaaaattgaaatttaaagaaacaagtaatgcaatgtttccaaagtggattcaaattccataatattattgcaaaacaaacaaaccaaacaaacaaggaaaacaaagaaagaagggattctaacataaaagaatttaaaaataagtaaatcagctcggaaaactcagcaggcta

SEQ ID NO: 57 - DNA, 599 bp, Homo sapiens
agtaaatcagctcggaaaactcagcaggctatatcttcctggtggttagaaatatctgcttattaaaaggtttcaaaggtcctttgggaatagaacttattgcaatgtgtttggctgtacatttcttacacttttttttttaactgaggagtcaattaaaatatcctgaagtgactgtccatagaacacattttgaaaacacaaatgctatataatcacaaatatatctccctcccctttgctagtgattgttaccaaactgcctctgctagctaggattcaactctttctcttaacaamtatgctttgatggaacaatttttttagatacaaatattgtcaatgagaacaattattatacagtgcagtcacagaagagaaacagaaaagaaagggaggtgcaacaaaatgaaggtaaatattagccttcacacttaaatacatttgatgaggggataaaatgtacatgtaggtgtggatttatgggctgtgtttttcaaacaattaccaaatatttattaaccaccaactcagtgtaagctagtacactaggtgcctatagtgatccagcaggctataaggcaggatttctgccctta

SEQ ID NO: 58 - DNA, 599 bp, Homo sapiens
gatacaaatattgtcaatgagaacaattattatacagtgcagtcacagaagagaaacagaaaagaaagggaggtgcaacaaaatgaaggtaaatattagccttcacacttaaatacatttgatgaggggataaaatgtacatgtaggtgtggatttatgggctgtgtttttcaaacaattaccaaatatttattaaccaccaactcagtgtaagctagtacactaggtgcctatagtgatccagcaggctataaggcaggatttctgcccttatagaattttggggcatattctcagtawcttttgtatctctcgccctcttttcttttttttgtgacacaagatgtcattctgtcatccaggctgtagtgcagtgacatgatcatggctcattgcagccttgacctcccaggctcaagcgatcctcttgcctcagcctcccaagaagctgggaccatgggcatgtgccatcatggcagactaatttttaaattttttgtagagatggggacttactatgttgcccaggctagtgttgaactcctgggctccagcagtcctcccacctcagcctcccaaagtgctgggattactggtgt

SEQ ID NO: 59 - DNA, 599 bp, Homo sapiens
gtgagacagagacggtggctatgaccagggcggggaagtgcaggtggtgagacatgattgggatgcagatagattttgagggtagaactagtaggacttcttgatggacaggatatgagagcagtcaagagaggtttggggccctgagtaactggtcaaatagggttgctagttactgaattaggaaatggcaggtggtataggttttagagtaggattacactagttttggccatattcagcttgacacctcattagacataaaactggagatgtgaacccatcagtaggatgaatatytgcttctgaaattcaggagacatattgggctagagatacaaatttgggatatgtcactgtatagatgaaattaaacccatgagaccaggtaagatcttcaaaagagtggaagtagctaggccatgagggcacaatagagcaacttctgattttcactgtaaaacatcccagagaataagtgttcatccttccctgaaggatgaatttggatctctgcatacaacactgcagaggtggtgagcatctggcatgaagtgaccctgagttctgacccaggccagctgcactgacctcaccac

SEQ ID NO: 60 - DNA, 599 bp, Homo sapiens
gggaaacaaaaatctcctgcccttgtggaattcatgtcctacaggaggacaataagtaacataaagaaataaaaaaaagttacaaaagatcttagagtgtgatccacttaaggagaaaaatacagcaggaggagagcaatttcaggccagatgtcctgggaaggccaactaggaaggagacatttaataaacagcccaggtcgaaagggcaggcagcatgaaagtccagccatggaggcaagcctggtgtgtccgagggccagtagggaagccacatggccaacagggcatgaggaactycagagcagtgagagctggttggagaggggtagagactagattgcgagtgagtcaccctgagcaccttggcttttattaagtgtgatgaagaccactggagtgtttcaagctaaggagtgacatgacctcaaacttgacgtaggtattaaacactctgaatgtgaaaacactcttaagaatggcaagggatgaggtatccaggtgagacagagacggtggctatgaccagggcggggaagtgcaggtggtgagacatgattgggatgcagatagattttgagggtagaactagtaggact

SEQ ID NO: 61 - DNA, 599 bp, Homo sapiens
ccacagtgctgtccttctggccatccttcatgcttttgtgttgcctgtcccattgcccttaatcttatatggaaaaatggaaataaattcagagcggaaacttatctaaaagttttgagggaaaaatgatcgaaaccagaattattcacaggacaacttgttctatgaataatttttgaaaaggaaccatttcctctacagctggcttattatgaggagcttgatgataaaatattggcaaggcctccagtggacatttatcgtgttgtgacagatcccagaaatgaatctgggtctccygacttcaatacagttctcttcttattacataatgagagaatatgattttctactcttttcttttactttacttgttgagaaacaactaatattcaattaaaagcatcaatcttacatattcagttgaatgagattcagcaatcatatcccccatgtatcatcatccatatcaccatcccaacagcacagaaagcatttcttcttcccagagagttgccctcacacctttccaatcaaatttccacatactctctagtttccagcatgatagattataatttgcctattgttgggcttcc

SEQ ID NO: 62 - DNA, 599 bp, Homo sapiens
tatatatatatatatatatatatataaaacctaacaaaaagttaaagaacatctactgtatggctcaataactccccccttacccaagagaattaacaaacatatccacaaaacacttgtaaaagaatgttcataaatgccatactcataataccaaaaattaaacataatccaaatgtctatcaacaggagaatggatcctttttttaatgtaaactactcagcaatgaaaaggaaggaaatactgatataaccataggatgactgtcaaaaacatcatgttatgtaactctgagttcrtttccaaacaaaaaaataataaagccttgctcctgaaaaattatgctaagcaaaagaaactaaacacagaagactacatattacatatcatacctataggaagcccaacaataggcaaattataatctatcatgctggaaactagagagtatgtggaaatttgattggaaaggtgtgagggcaactctctgggaagaagaaatgctttctgtgctgttgggatggtgatatggatgatgatacatgggggatatgattgctgaatctcattcaactgaatatgtaagattgatgctttt

SEQ ID NO: 63 - DNA, 599 bp, Homo sapiens
gatccattctcctgttgatagacatttggattatgtttaatttttggtattatgagtatggcatttatgaacattcttttacaagtgttttgtggatatgtttgttaattctcttgggtaaggggggagttattgagccatacagtagatgttctttaactttttgttaggttttatatatatatatatatatatatatagtgtgtgtgtgtgtgtgtgtgtatatatatatggtgtatataatttatatacactaaaatacacacatttttaagtgtaaagttcaataagttttgatayatgtatactccattggctttgttttgtattgctataaaataatacctgaggctgggtaatttattaagaaaaagtttatttggctcatgattttaatggctgcaaagttcaagactgggcaactgcatctggtgagggcctcaggctgcttccaatcctggtggaaggttaaggggaggtggcttgtgcagagatcacatgggagagaagaagcaaggggtgggggagtgctaagttctttttaacagccagctcccatgggaagtaatagagtgagaactcaccaccaagggagggga

SEQ ID NO: 64 - DNA, 599 bp, Homo sapiens
ctcaccaccaagggaggggattgaaggagggaattaatctattcatgagggatccacccccatgacccaaatgctcccccttaagccccaccttcaatattggggatcaaatttcaacatgaggtgaggagggtacaaatatccatgcataccacctctgaaaccatcatctcaattgacatattccacaaatctctctcatactcctttataagtaattgctacccttcatcttccattctaggtacccactcactggccttgcagtttgggaacattatataaatgggacgatataayatgcattcttttaaaactggcttctttcattcagtatgtttctaagattcatcagtagttcttttttttttttttgctgagtagtgttccattgtatgaatatagaatagtttagccatatatgtgctgacggtcattggtcttgtttccagtatttggctatatgaattgaactggtatgaacatttgtgtacaagtctttttgtgtgcataagtttttatttctcttaggtaaatccccaggaagagaatttctggagtgtaacacaagcacataatcagaaactgccaaactatgt

SEQ ID NO: 65 - DNA, 599 bp, Homo sapiens
taaaaaacctgcacgttgtgcacatgtaccctaaaacttaaagtataataaaaagaagaagtagaatctcattgtgattttaattgtttacatttatctaataactagtaactttgtgcactttgtcctgtgcttattgaacattgatatattttcttttgtgaaatatcagtacaagtcttttcctcattttaaaaattgggctattttatctttttcatatgaacttgtaagagttatttatgaagtatagatacaagtctttcatctgatatgcaaattatgagtattttgtctggwctgtggcttagtctattcaaattctaatgatgtctttgaagaagaaaagtttctaattttaataaagtcccagctatgatttatttttctttcatgattagtgatttttgtatccatttaaaaaatatgttcctacttcaggtttaagatgttctgttatgtaatacaatccatttttatttcatttttctgtataatatgaggtagagctttttcacatagagagtcaatttttctatcattatgtgtcgaaggcagtgtttttcacaataaacttatgttggcactttaatcaaaca

SEQ ID NO: 66 - DNA, 599 bp, Homo sapiens
tcttccaccacaaacccatagccaccaccaatctgctttctgattctatgggtttatctattctgaatatttcctataaatggagtcacacaataagtgccctttgtgactgccttatttcacttagcataatctttccaagttttgttcatattgtagcatgggtctgtactttattgtttctaatgactgaataatattccactgtgtgtgcctaccacactttgtttatccattcatcccttaatgggcatctgggttgcttctagctattgactattttgaataatgctgctatcrgtgtccaagtatttgtttgagttcctgaccaatcaattttgaattgcaatgtctcctctcccaatccccatctccttaacctgctccaatctttttctaaggcattcatcacttctaacattctacttatgcatcatgtttattattttctgttttatccattggaatatgacctccagaaggcaatattatttttgtgagttttgtctattgatatagctcatgtgcctggaagagcaccaagtaggtgctcagaaatgtttacttattatcattattattattatttctgaggcaag

SEQ ID NO: 67 - DNA, 599 bp, Homo sapiens
ctggaggtcatattccaatggataaaacagaaaataataaacatgatgcataagtagaatgttagaagtgatgaatgccttagaaaaagattggagcaggttaaggagatggggattgggagaggagacattgcaattcaaaattgattggtcaggaactcaaacaaatacttggacaccgatagcagcattattcaaaatagtcaatagctagaagcaacccagatgcccattaagggatgaatggataaacaaagtgtggtaggcacacacagtggaatattattcagtcattagaarcaataaagtacagacccatgctacaatatgaacaaaacttggaaagattatgctaagtgaaataaggcagtcacaaagggcacttattgtgtgactccatttataggaaatattcagaatagataaacccatagaatcagaaagcagattggtggtggctatgggtttgtggtggaagaggaagaatggggacttcatgttaatgggtatggggttatactcggggatggtgaaaatgttttgaaactagatagagttagtggttgtaccacattgtgaatgtaccaaatgtcactaaa

SEQ ID NO: 68 - DNA, 599 bp, Homo sapiens
cagatgcccattaagggatgaatggataaacaaagtgtggtaggcacacacagtggaatattattcagtcattagaaacaataaagtacagacccatgctacaatatgaacaaaacttggaaagattatgctaagtgaaataaggcagtcacaaagggcacttattgtgtgactccatttataggaaatattcagaatagataaacccatagaatcagaaagcagattggtggtggctatgggtttgtggtggaagaggaagaatggggacttcatgttaatgggtatggggttatactyggggatggtgaaaatgttttgaaactagatagagttagtggttgtaccacattgtgaatgtaccaaatgtcactaaattgtgcacttcgaaatagttaattttatgttatgtaaatttcagcgcaatttttaaaaatcagaagcaaaaaaagaacagaaaattgagtagttaggctaagtctcacagagaatgtacagtttgagtgctcacttggaggaggtaagttagctcttggaggaggtgggtaacaggaagaagctgtccaggcagaaggaacaatgtctgcctagtgccttca

SEQ ID NO: 69 - DNA, 599 bp, Homo sapiens
tgtcttttttatacactaatttcttttccttagaaaagtagtgagatttctgggttgaatggtagttttacttttggttcattgagaaatcttcatactgttttccttagagattgaactaattgacattcccagcaacaatgtataagcattcccttttctccatatccatgccaacatctgctgttttttgagtttttgataatagccattcagacgggtcttctggtttttggaggggaggattgggtgaagcaagaaggagtttggagggaaggagtggaggcttgagtgggcctmgagtttggagtatgggcaagaaggatcccagagacaagcactttgcccacagctacacagctaatggagctggggggcccagcatattctccagaggcccaggctaggccgtctaggggcatgcttgttctgccccatccactgcaggtcctgaaaacattttcatcaataaaaaaaaataaaaaaacagaataaaaatgatacccagatgtcctctagtgaaatgaggggaaaaaaaacatccatccccagcttattgtgagagtcactgaatgagagcctgactcactgaaattcat

SEQ ID NO: 70 - DNA, 599 bp, Homo sapiens
acaaaaaacaaaagaacaaacaaaaccttatgttttgagggcaacaactaactgctggcatatggaatgtgacactcaaatacttccgaacttagaaggtatctttcaagacttcttcatttgacttagcagatatcacactgaaatgtaaaatgtaaatgtcctaacacactccagagctggccatgtgtggcctgctcttactgtaaaccagtgtcaaaagacagggaacttggttacattaatcttatatgaatttcagtgagtcaggctctcattcagtgactctcacaataagcyggggatggatgttttttttcccctcatttcactagaggacatctgggtatcatttttattctgtttttttatttttttttattgatgaaaatgttttcaggacctgcagtggatggggcagaacaagcatgcccctagacggcctagcctgggcctctggagaatatgctgggccccccagctccattagctgtgtagctgtgggcaaagtgcttgtctctgggatccttcttgcccatactccaaactctaggcccactcaagcctccactccttccctccaaactccttcttgcttc

SEQ ID NO: 71 - DNA, 599 bp, Homo sapiens
gggttattaaaataagctagtctataatttcttctttgaaaagaactaaattattttggcttctcactattcaggcaccattcaacataacagagagtagtttatagcaacttaagacaaactgcaaaaaggcaagggcttctaatacatgaataaagcaaggcattttaagcacccataaatttctgccaacttaatcagaaatcttccagtgtccgcttgtttctctggcaaacacccacttttttaagacttctcataactactctcccttttcagattaatctcatagaatctaasctcattgaaccagctttttcttaattttgttacagttttgaaatcctgtatgtgcctatttataatctacttcacttacataaccattaaaaaaacaaaaaacaaaagaacaaacaaaaccttatgttttgagggcaacaactaactgctggcatatggaatgtgacactcaaatacttccgaacttagaaggtatctttcaagacttcttcatttgacttagcagatatcacactgaaatgtaaaatgtaaatgtcctaacacactccagagctggccatgtgtggcctgctcttact

SEQ ID NO: 72 - DNA, 599 bp, Homo sapiens
gatgaaattctgcaggagtatttattaaagttgaactcttcctataaaataattcagttgttcatttgacaattaagacctttcattcaaagtacaatactctgtggtacttatcattaacatcactcaaattttatagttacaaataaaaacccaaggataagactgtttaagtaatttgacaaagttcacccagttgtggctggggttgaaaccagacttgctgaacttcaaagtcaagcttttctccccccaatgtcaactaaaaaaagagaacattctctataccagagattaggstggtaaagcttttctttttataatttggactgggttattaaaataagctagtctataatttcttctttgaaaagaactaaattattttggcttctcactattcaggcaccattcaacataacagagagtagtttatagcaacttaagacaaactgcaaaaaggcaagggcttctaatacatgaataaagcaaggcattttaagcacccataaatttctgccaacttaatcagaaatcttccagtgtccgcttgtttctctggcaaacacccacttttttaagacttctcataactactc

SEQ ID NO: 73 - DNA, 599 bp, Homo sapiens
tgaataggtttgttcaataaaataacacaaactcggaattcttttacatttggtatcccaaaacatctttttaaaacatgtattaagttggagcattcattcttaaactaggccacgtaagcattagtttctcagtttaaaaaataaagcttccatcaattttaacatcataatgatgaaattctgcaggagtatttattaaagttgaactcttcctataaaataattcagttgttcatttgacaattaagacctttcattcaaagtacaatactctgtggtacttatcattaacatcastcaaattttatagttacaaataaaaacccaaggataagactgtttaagtaatttgacaaagttcacccagttgtggctggggttgaaaccagacttgctgaacttcaaagtcaagcttttctccccccaatgtcaactaaaaaaagagaacattctctataccagagattaggctggtaaagcttttctttttataatttggactgggttattaaaataagctagtctataatttcttctttgaaaagaactaaattattttggcttctcactattcaggcaccattcaacataacaga

SEQ ID NO: 74 - DNA, 599 bp, Homo sapiens
agttcaactttaataaatactcctgcagaatttcatcattatgatgttaaaattgatggaagctttattttttaaactgagaaactaatgcttacgtggcctagtttaagaatgaatgctccaacttaatacatgttttaaaaagatgttttgggataccaaatgtaaaagaattccgagtttgtgttattttattgaacaaacctattcagcacttggggaatcgcaggcagcattgcagactcgctggctcctggctgtgatctcacacccaaactgcaataatatcctgataaaacrgacttccacaagtaggtcaagaataataatgtgcagacctaattcctctaatttacggcgaacatctcatggtcaatctccccgcggtcaaaggactgtgtatctcttcctctcagagccactccacaggctgaaaggctgactaaacccctgacagataagagattcaagagtagtcccagcccccatggggagcaaagacgctggctcaaaaaacgtactgataactctcccttttgcagctactcctttctgaaccttccacaagcagtggcagttggattctgtgattagtctag

SEQ ID NO: 75 - DNA, 599 bp, Homo sapiens
atgggcatcataataatagcgcctgccacattgggtgagtgtgagaatgaaggaattaatacatgtaaatcacttagactgtgtctggcatagaggacattctaaagaaaagttagctattatcattatattattatatgggtctggaattagttcctgaatccttctgagatgtgatgacttataaacgtaggttgagtttactcatgatagggtcatcgcaactatgcatagctaaaatcaaattttgcttttcaagtttgttttacctggagccctagagttcagggttatggtttyctttgtcactccccttgagggaagcttcttagtcacactctccttctctttctctgcactctatgcactctagaaaagctcctttttttttttcttcatccaggcagagaggcctactgggacttaaatccaaggagctgaaatctgttttgggatggggtggagtcacattctggaacctagacagagaatttctaagttccagaaagtgctgcttacttcgcatttcctctcccccacctttgcttttgaaactcctggcaccaatgctgccaaggctggcggagctttcctgagtg

SEQ ID NO: 76 - DNA, 599 bp, Homo sapiens
actcacaaacaaacaaaagtattcccactcaggaaagaaatcgtgtgtttgcctcaggccaacttctgaagtttctaccagctgcagttgctgattctggtatttatacctgtattgtcagaaggtattatgcagaaggctcccatcttctttcaccctgctcccctttcttcagtggttgattgcctgagctgcccttgctttcattccttccctagtcctttctggaacagttaaatttataaaatgatttgaataaaagtgatttggataaacttctaggaatactatcaggttgakgtctagctcattctgagctatttggatttacagttgcagggattgatttgtagctgacttagagaaaaacctagctttcctagtgaccaagataactgagagcaattgcttacttttggctggaattaagaacaaactagcacagaaaatagtaatctggatgttttccatctcagggggcctctagtaggtgaaaaggggcttctaaccttcaagttaagccacagaaggctgatgagattgtgtgcctaaaaattaattacttttgttcacaaattgttaaatgttttgattttgtg

SEQ ID NO: 77 - DNA, 599 bp, Homo sapiens
tatgcattttacagagaaggaaactgaagggcagagaagtaacttgctggcatcgcacagttaactagtggcagagcatgaatttgacacttgtctagtctcagacctaggcccttaactaatacatcctgctttttgatttaattcatttgacattttgtgtgtgccaaatacagccacaaaatcaaaacatttaacaatttgtgaacaaaagtaattaatttttaggcacacaatctcatcagccttctgtggcttaacttgaaggttagaagccccttttcacctactagaggcccmctgagatggaaaacatccagattactattttctgtgctagtttgttcttaattccagccaaaagtaagcaattgctctcagttatcttggtcactaggaaagctaggtttttctctaagtcagctacaaatcaatccctgcaactgtaaatccaaatagctcagaatgagctagacctcaacctgatagtattcctagaagtttatccaaatcacttttattcaaatcattttataaatttaactgttccagaaaggactagggaaggaatgaaagcaagggcagctcaggcaatcaac

SEQ ID NO: 78 - DNA, 599 bp, Homo sapiens
atgaagtgacttactcaaggccattgatgatgttgaaagtattgcaaacaaagattaaaaaccactcgacaacatttatgtacaccatagtataccatcacaaagcctctcattagactttgaatccaatgagtattactaaagattaagctcttttttaatttgcagaaactctgacaccaaactagaaaaaaaaaaaaaaagctggttttgctctccaaatagttgtattgccattcaaaaaaagtaagttaagttagcattcagattgctttatctttggaaaattaagtcacaaaraaagaataaagaacagatgtggctttgaattagtaatgtaatttccccctgaaatttcttaaatcttgatagtgtgttcagaaaacctctttgcgtcatagttcagaatgtataagataagatggagcaggaggaagtaaagggaggagggagaagtgcaagaaacccaaccagaagggcaccgctgttcccacttcgacttctttcacgtagtattctatctcattaatgtcagtagcttacccttgaccgtgaaggacctggtcgccgtcacactataattggctccattttcattg

SEQ ID NO: 79 - DNA, 599 bp, Homo sapiens
ctccaatattgctttgccctgaaaaaactgtcatacgtaaaggggctattacatctacgtctgtagatcgacttgtgctaaggagaccccaatcctttgtagattgataagctatgattgtgaaatctttcccttaaataagcttttataaaatttaaaataacttggaaaacacatttttagaatgaagtgacttactcaaggccattgatgatgttgaaagtattgcaaacaaagattaaaaaccactcgacaacatttatgtacaccatagtataccatcacaaagcctctcattaractttgaatccaatgagtattactaaagattaagctcttttttaatttgcagaaactctgacaccaaactagaaaaaaaaaaaaaaagctggttttgctctccaaatagttgtattgccattcaaaaaaagtaagttaagttagcattcagattgctttatctttggaaaattaagtcacaaaaaaagaataaagaacagatgtggctttgaattagtaatgtaatttccccctgaaatttcttaaatcttgatagtgtgttcagaaaacctctttgcgtcatagttcagaatgtataa

SEQ ID NO: 80 - DNA, 599 bp, Homo sapiens
aagtaacaggttgctttcttagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcrggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactca

SEQ ID NO: 81 - DNA, 599 bp, Homo sapiens
agtgcctgcctttgctttgccttctgccatgagtaaagctcctgaggtgtccccagaagcagatgccgccatgcttcccatacagcctgcagaactgtgagccaattaaacctcttttcatataaatcacccagtctcaggtatttctttatatcaatgcaagaatggcctaacaaatgtcttattataaagtagcacctaggattttctcactgaaatggcagtagtttgatacttcccctttttgttcactttaccaccctcgctaacaaaatgagtgttcattatgaccagaaaaasgtatagaacggaccatgcttacaacatgtaatgcaagttataaaagagcacaaaagaacacgttcagtttacggttgttggtgcatttcctttcacatacagtgacacagagggagttcataaagttagaaaacaaggatgaccaaagaagcagctgagtgttctagacaaaccaacgataggagggagtgggggaggacgaacaatttaagcagcagagaagctcccagcaaacaggaacagtctacaaagatcagacagcaaacaacatcccgaagaagagaagcacattttatggc

SEQ ID NO: 82 - DNA, 599 bp, Homo sapiens
ttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcamacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatt

SEQ ID NO: 83 - DNA, 599 bp, Homo sapiens
tcaatacttcaaagtaaaagacaaagaaagttgaataacttgcgaaatactacagttatggagcaaggattcaaacacagccagcattttcctagctatatgtgtatacagaaagtaatgttttgtcatcacatacctgaattacttatacttttataaaataattcacacttacgaagacttcctctgatgtcttggatcaacttctttcctctacttggaagcgtccagccaatggcatggttacttcccagcaatccccacaggaagtacacattcctctgtgcatccagctggggwttttagagagagagtgacctggaaaggaatcctgttgaaatgatttacttacggagttttcattatttaacctgatgacagtaagctctttgtcaattttcactttttccccccaattttgtgtcacatcaccttgataattcttgattccatactgctggtcattgagagaactgataaactattagaggttgtggaggaattcgtgaatatgggccagtgatttttctaccttaaaactgggagcccatgcatggagacttaagacggaaaagaaccgtatcagcaaatctcatttg

SEQ ID NO: 84 - DNA, 599 bp, Homo sapiens
agtgtatttttaatgctaatcaatgtcctggttatcatcctaaaaatgttctggattgaggccactctgctctggagagacatagctaaaccttacaagactaggaatggtaagtggcaaataccaagtttttctcccaaagaaaaagtcccataataactgttggttacctgtctattaatctttcagtagctaggctgctaagcccagattccattttgcttgctaatctgttatcagtgagttgtgtttttggattttcttaaaggccattttccatcctgctatgtaaatcctcayggtcctgagatccatctcaacagctcacttttcttccccgataggattgctattcctactgagttcccaataacagaatctgccccaagcccagaaaggtgtaaatttcataatgtatcggtaagacattatgaagttaaacacagtagcaaaattgttcctgttttccagatgtgagcaggttagaaaggtccatcggaatgcatgtgtgttctacctgaaaccctgatctgtaaagtctaacccaggcacacaagcatgtgcatgaaaggagtcagttctgcctgctagatgcaaac

SEQ ID NO: 85 - DNA, 599 bp, Homo sapiens
gatgcaaacttcatgcttacatttggaggcagatacatgttgcatttttcaaacagttgactgaagtaggagctcattgtttgatctgtggaaaattcagatcccttaaaaaattctatgcccttgctactattagctttaaattttttcacttccccaggggagtatggggaaaccaaagatgaaaccaaagtctattcagcacagaaggcccccttagtcatagattattaatcaaaattgatgagatggacaggttcttgtccacttttttgttatttagtctgtgacagtaaaaasgagaaacactttgggatgaagactgttatttcctgatagtgttttgtggcagtggtttgacgtcaacatctcttgagtctagaatattttggaggatgacatacattcaccaacagccataaaacttggagaggaatgtcttcaaagagtccagtgagaatttttagaatcaagtaagaagttgtacttcttgttttcattttcagatggaaagctctatgatgcttatgttgtctacccacggaactacaaatccagtacagatggggccagtcgtgtagagcactttgttcaccaga

SEQ ID NO: 86 - DNA, 599 bp, Homo sapiens
cacggaactacaaatccagtacagatggggccagtcgtgtagagcactttgttcaccagattctgcctgatgttcttgaaaataaatgtggctataccttatgcatttatgggagagatatgctacctggagaaggtaaagctattgacatacattagggacagaaattcatgcttattaaaggctgtgaactaggtggccttatccctgcattggataatgaattgcatttactaccacaggccttaagaccagaactttaaatatttatccagaagcagacacttatccttcaatcgyccctctcccatcattgtcctggtgatgagatcttcacagtaatgttggtggtgtgaattcagagttagaagtcctttgcttcaaggacttagcaaaccatcatccctactttattcccttggtcccccaccaggataactctgccacttcttaattctgtccataagatttgaaagaggacttaaaaattgatgagttttgttctggtagccataggcactagctgaaataccttaaaagtactcagagagtcttcatgactttctttatgttggtgaaacatttgcaaatttatattc

SEQ ID NO: 87 - DNA, 599 bp, Homo sapiens
tggccttatccctgcattggataatgaattgcatttactaccacaggccttaagaccagaactttaaatatttatccagaagcagacacttatccttcaatcgcccctctcccatcattgtcctggtgatgagatcttcacagtaatgttggtggtgtgaattcagagttagaagtcctttgcttcaaggacttagcaaaccatcatccctactttattcccttggtcccccaccaggataactctgccacttcttaattctgtccataagatttgaaagaggacttaaaaattgatgarttttgttctggtagccataggcactagctgaaataccttaaaagtactcagagagtcttcatgactttctttatgttggtgaaacatttgcaaatttatattctcaccagaacaaaaagaactatagcttctgttccttaatattcctacccaattttatatacttttgacagttttatcacaactcctgtgtttgcagtagttatttttcccttcccttcatacatttatgtccagtacctgtggaccctccttgtgaactcttctctaatttctcacagaccaggaagggtttggaa

SEQ ID NO: 88 - DNA, 599 bp, Homo sapiens
gtggagaggcaggtacatgaccaccctctgacctcctgccagtgcctcccattggccaaacccagcctggagcagaggacaagggtgcaatggattccatgatgatcagccacccagggccactggatggaatggtggtgcagagaggattttgatggggcaaatgcaaggtaagttgcatgagactatagacagtaccttagtcagtcatgaactttcctaagtgaagagtgaagtttggtgttgttgggtttcatttattttggttgaggaaaggtcagaggacatgcattgacagarggaagtagaaaaccattccagattagtatgttgtcacacattgaaggcagcacaagcttgagtgtgagagagctagcatctgggtttggctgaggagaagtgtaactagaacttaggtggatagactgaaaaagaagaggtgaagagcttgtggccagatgtggcacattgttgagctcacaaacaacaggagtccctgcaggttcttgagtacatttgtaatatgaaaagagtgtttgagagcattactcattacttctacctgcatgggtggccagtgggaaaatgggggaagaaga

SEQ ID NO: 89 - DNA, 599 bp, Homo sapiens
caaccaaaataaatgaaacccaacaacaccaaacttcactcttcacttaggaaagttcatgactgactaaggtactgtctatagtctcatgcaacttaccttgcatttgccccatcaaaatcctctctgcaccaccattccatccagtggccctgggtggctgatcatcatggaatccattgcacccttgtcctctgctccaggctgggtttggccaatgggaggcactggcaggaggtcagagggtggtcatgtacctgcctctccacgtggggcttctggagcagctgtgcttctccytctgggagcacctcttctcagctggcctgcctcatgcatctgcaatccctcagacacccgtctgtgagaatatcttggattgttttattcacggttgtgctttctcctgttgcagtgaggactgggtatttcatgttctttctgagtccacccagagctaattggaatcaccatggtgtctacgctgtataaatgccaaatgggaaaggggatctattgtcccttgagatttttctagtttggatcaaatcagtttctacaacagagattaatgggggtgaagtaaagtcaggacttac

SEQ ID NO: 90 - DNA, 599 bp, Homo sapiens
cattgcacccttgtcctctgctccaggctgggtttggccaatgggaggcactggcaggaggtcagagggtggtcatgtacctgcctctccacgtggggcttctggagcagctgtgcttctccttctgggagcacctcttctcagctggcctgcctcatgcatctgcaatccctcagacacccgtctgtgagaatatcttggattgttttattcacggttgtgctttctcctgttgcagtgaggactgggtatttcatgttctttctgagtccacccagagctaattggaatcaccatggygtctacgctgtataaatgccaaatgggaaaggggatctattgtcccttgagatttttctagtttggatcaaatcagtttctacaacagagattaatgggggtgaagtaaagtcaggacttactttcctagagactttggacaattttgaggggcaaagcttcctgagtttgtgatttttaatatgtgagttaaaattttaagccattgaaaaacatataagcaaatattctaagaagataatatgtattctaagaagaatgaaccagaattctaagtctctaatgcaacaatagactaa

SEQ ID NO: 91 - DNA, 599 bp, Homo sapiens
agacacccgtctgtgagaatatcttggattgttttattcacggttgtgctttctcctgttgcagtgaggactgggtatttcatgttctttctgagtccacccagagctaattggaatcaccatggtgtctacgctgtataaatgccaaatgggaaaggggatctattgtcccttgagatttttctagtttggatcaaatcagtttctacaacagagattaatgggggtgaagtaaagtcaggacttactttcctagagactttggacaattttgaggggcaaagcttcctgagtttgtgmtttttaatatgtgagttaaaattttaagccattgaaaaacatataagcaaatattctaagaagataatatgtattctaagaagaatgaaccagaattctaagtctctaatgcaacaatagactaaatatctttacattcccatttacttggaaggactctgttttagttaagactaagctacctgggaaataaaaagaggacattggggctgatattctcacaaatgaaaggaacacaaagaacaaaacgggttctctatccacacatacttccacttctctgagtaagtgacttgatg

SEQ ID NO: 92 - DNA, 599 bp, Homo sapiens
gactttggacaattttgaggggcaaagcttcctgagtttgtgatttttaatatgtgagttaaaattttaagccattgaaaaacatataagcaaatattctaagaagataatatgtattctaagaagaatgaaccagaattctaagtctctaatgcaacaatagactaaatatctttacattcccatttacttggaaggactctgttttagttaagactaagctacctgggaaataaaaagaggacattggggctgatattctcacaaatgaaaggaacacaaagaacaaaacgggttctmtatccacacatacttccacttctctgagtaagtgacttgatgtcagagaatctcacaccagattataacaataagacttttaaatgttcaggatgtttatgtttaaagcattagactgataagaaatctgatctatttcttgtatgactagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgat

SEQ ID NO: 93 - DNA, 599 bp, Homo sapiens
tataagcaaatattctaagaagataatatgtattctaagaagaatgaaccagaattctaagtctctaatgcaacaatagactaaatatctttacattcccatttacttggaaggactctgttttagttaagactaagctacctgggaaataaaaagaggacattggggctgatattctcacaaatgaaaggaacacaaagaacaaaacgggttctctatccacacatacttccacttctctgagtaagtgacttgatgtcagagaatctcacaccagattataacaataagacttttaartgttcaggatgtttatgtttaaagcattagactgataagaaatctgatctatttcttgtatgactagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagt

SEQ ID NO: 94 - DNA, 599 bp, Homo sapiens
actaaatatctttacattcccatttacttggaaggactctgttttagttaagactaagctacctgggaaataaaaagaggacattggggctgatattctcacaaatgaaaggaacacaaagaacaaaacgggttctctatccacacatacttccacttctctgagtaagtgacttgatgtcagagaatctcacaccagattataacaataagacttttaaatgttcaggatgtttatgtttaaagcattagactgataagaaatctgatctatttcttgtatgactagatgtagtcactrcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgagg

SEQ ID NO: 95 - DNA, 599 bp, Homo sapiens
aataaaaagaggacattggggctgatattctcacaaatgaaaggaacacaaagaacaaaacgggttctctatccacacatacttccacttctctgagtaagtgacttgatgtcagagaatctcacaccagattataacaataagacttttaaatgttcaggatgtttatgtttaaagcattagactgataagaaatctgatctatttcttgtatgactagatgtagtcactgcagtggaaaccaacatacgaaagagcaggcggcacattttcatcctgacccctcagatcactcacaayaaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaa

SEQ ID NO: 96 - DNA, 599 bp, Homo sapiens
caataagacttttaaatgttcaggatgtttatgtttaaagcattagactgataagaaatctgatctatttcttgtatgactagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccrgcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggt

SEQ ID NO: 97 - DNA, 599 bp, Homo sapiens
gtatgactagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattcyaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccacca

SEQ ID NO: 98 - DNA, 599 bp, Homo sapiens
ccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgaytcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccatcctccagccaccattttcttcccttttcccttttgcttgcctgtcttcactgtggtgtgggatgttttca

SEQ ID NO: 99 - DNA, 599 bp, Homo sapiens
gatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactccctyggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccatcctccagccaccattttcttcccttttcccttttgcttgcctgtcttcactgtggtgtgggatgttttcactactc

SEQ ID NO: 100 - DNA, 599 bp, Homo sapiens
taggcatgtgccatttggggctgttgcagttggagagcttccttgagaaggcaaatactgagccaagttgaaaggactctagggacctggcatctgggataagtggggagggtggcccaggtagcacaggcataggcagatttggggggaagcataaggctaacaacagacacttgtgtgacaaggactatgaggtggcattgattttcttggccttacagatgagaagccagattccacacaaattattttgtttgttagagtttaagcgtgtgtgtgtgtgtgtatgttatgccccamgatcattttctcctctttgcatttggttgttttatcatctcacaggctgagtaaaacgactatgcatggaacactgtagaagaaaaattatattaaaaaaaaactggtgttatgattttcatccaggcattttgtctcaggagttgctcgattgtatgtgttgctaatgagtgatttatattgaggcatctacattgattcatgtgtgtccttgtgaatagctgtaatctgaggctggccatttcacttcctcaaatctcaggttcctcattagaaagagctttgaaatggctctttcc

SEQ ID NO: 101 - DNA, 599 bp, Homo sapiens
gaaggcaaatactgagccaagttgaaaggactctagggacctggcatctgggataagtggggagggtggcccaggtagcacaggcataggcagatttggggggaagcataaggctaacaacagacacttgtgtgacaaggactatgaggtggcattgattttcttggccttacagatgagaagccagattccacacaaattattttgtttgttagagtttaagcgtgtgtgtgtgtgtgtatgttatgccccaagatcattttctcctctttgcatttggttgttttatcatctcacagkctgagtaaaacgactatgcatggaacactgtagaagaaaaattatattaaaaaaaaactggtgttatgattttcatccaggcattttgtctcaggagttgctcgattgtatgtgttgctaatgagtgatttatattgaggcatctacattgattcatgtgtgtccttgtgaatagctgtaatctgaggctggccatttcacttcctcaaatctcaggttcctcattagaaagagctttgaaatggctctttccctgtacattatgtgtttctgtgaattacttttagagaaaggtcagt

SEQ ID NO: 102 - DNA, 599 bp, Homo sapiens
taaaaaaaaactggtgttatgattttcatccaggcattttgtctcaggagttgctcgattgtatgtgttgctaatgagtgatttatattgaggcatctacattgattcatgtgtgtccttgtgaatagctgtaatctgaggctggccatttcacttcctcaaatctcaggttcctcattagaaagagctttgaaatggctctttccctgtacattatgtgtttctgtgaattacttttagagaaaggtcagtttctcagggtgggacccataaacaagggcaactgggcagagccagggrttcaggtgactgtttggaccctctggaagggctttttactgtgctgccttgggagacagagtggtcagcttggaactgaccttaagcctaggtcacccaatttttgaaggaaacttttttttttcatttagagaaaacttcatgcctttgggtgattaggtaagtttgtgactattcgttatgtgtgtgtacacacacgtacgtacatatgtacatgcacaaatatttaatatgtcttagacacaccaaatatatgcatttaagatgtattaaatgtactttcctgagaatacaaataa

SEQ ID NO: 103 - DNA, 599 bp, Homo sapiens
ctacatcaatataaaatttgtcatatattagcataacaaaagagagaaagtaaacaacaagttagacaaacatctgagaactggacaaaagacataaagagatggttcataaacatgaaaataaaatggctgataataagtgattaatatttgcctcatttatacccaaagaaatgcaaattcagaaaacaatgagataccatttttccattttggctgtctaattacattttaaaagtaaagctgctcagtgtgcttctgggtgtggtcgatagatgctgtcttgtgctattgagtgaragaatatgaatattgcaacacttctggaatgcagtttgtcagcatgcatctgtcaggtttcaatgtagtcttcaactcaatcactgtactgccatcgagtaacatccaggaaataataagaaatgtagacaaataataatagctaacatttaagcggtattaccattcaccagacacttgcaatagtaactcatttaactttcacatcagttccaggagatggtattattatccccttctatagataagaaaattgaggcacagaacaggcaagtcagttgcccacagtcggttagctg

SEQ ID NO: 104 - DNA, 599 bp, Homo sapiens
aataaacaatctgtgacatgctgagctatgtatggcagttctgcccatgtaacagagtgtgtgtgtgtgttttcacatcaaaacattcctgaattgtaatgagatcttcatttagggttgaatttttaaaactccatcttcctccttcagaacgtaggtttcataattctttcataattctaggcactaagtctattttgctcttcactgtatcactaaaatccagcacgatgcctagcacatggccagcactcactaacatgtgtcactgaggcataggtgtgtatgcatgtgttcgcrtgtgtctgtggctgcccatatgagtttactttagggaaatggagagatgaagtgacagtctcctacactccagacccctcctttacattgactgtgtcccagtggaactaagatctgcattgaactttgatcctactgcaacctagcattcggagttctgattacaactttgagcccagtggaggaaggatcccccacagtggagaccattcagagtctaaatactgcataaacaacaccatatcccttgtttaccatcctgagtgcagggagcacagcctgatggcagagtctggttt

SEQ ID NO: 105 - DNA, 599 bp, Homo sapiens
ctgctctcactacatgaactcagactgcagaatcttttcttttctgaataaattcagcatcttcagtagccaccacataaaaaaaaaaactttgacattcttcctcaattactcatgaaatatgtttgagagtatgtataatcacttacctgcagtgcttacagatataagcacccaaagggtcaagggtaattctctacaattcatggtttggattctgcttcaaatggcttctctggaaaacagaataaaacagattcagccaaagctttcaaacaaaagtgtgcctatcttatgaargtttaaaaatcttctggcacacagatttttaaaaaaacaacctagaagatttttataatccttaatatagtaaccaattctcagaactttcagccatataaaattaataaaatttcaaggcaatgaagtttttcttctggaagaaatccctaataatttatttctctgatacaacagagtctgaagaatttcaggcctggtctactaaatcctgcttccaaggccaaagttcagaacaatagtactgctacaaatattaccattctatgaataaacaatctgtgacatgctgagctatg

SEQ ID NO: 106 - DNA, 599 bp, Homo sapiens
atgccacccaggaagctgacactgccccattcgcaacacattaatattatcgtgaagtccgagctgctgatttcatttgactgggggcatgtagacaacaggagcagctgaattttaaaactgactttcatgcaatcgtcacttgtcattggtaaggatcccctaaaaggaaatcctatcaaagtaatctcctttcattaaggtcactaagaaaataagcagagagagataaacttattctgttccataacaaagaatgtatttcatgtcataggaagagtaggaaagaaaaggatgtgstgattatctgacctttcagattactgcatatttgagttgctgaacaaaggacaagagggctgtgaaatacattttgaaaagaaagggttactcacttcatttggaaaaagtaagatcctgtgtcattcaactcaactggccaaaactccaaaacacaatcatgcaaagcaattctcgaggaactccttgggttcagctccacatgttcctgtgatccactgcttttgtaccagcttttggtggttgtttcaatctcatgtgcaagtgaacacgagcaatgtttcagatagaaaggttcc

SEQ ID NO: 107 - DNA, 599 bp, Homo sapiens
atactgcttactaattatgctatatttgaatatgtctgtatcttctatgctcctgggtgtctaaaacaacctgcttccatgtagaatcccatttattttcaaggccattgtcaaagctgcttctctcctcaacactttactctcatagtgatcagtctccaatatccactctgggacacctcatttttcttagcatctcctatctgctaccctgtctctccacacctctctctgacatcctgcctcaatctcttgcttccattgttgcttcctaagccaggctgtattctctactacccrtatcagaaagatggccaatgccatttgcttctgttatctccaagtgatgatcatagatgcctggctgttcctctcaacgtgctctctcaggcctgtccagaatactttattcctttaaattgtgccttcattcaatcaggagttggaagtttgtggtggggggggcggtgtttgttgttctttttcctttaccccatttgtgagtattcattcttccttagcttgttatgaaaaatcccagttgtgacccatttctgtaattatcactcttaaaaggtcatctaaagatgtactgattt

SEQ ID NO: 108 - DNA, 599 bp, Homo sapiens
ctaaaaattaaagaattactgttctaacgggaaattttcaggtgtaaagtctgttcactgatagatcccacatcaaactgcaaagggttacacacctaagttagaacacatatgtgtatacacacacatctgcagtaaatactgcttactaattatgctatatttgaatatgtctgtatcttctatgctcctgggtgtctaaaacaacctgcttccatgtagaatcccatttattttcaaggccattgtcaaagctgcttctctcctcaacactttactctcatagtgatcagtctccartatccactctgggacacctcatttttcttagcatctcctatctgctaccctgtctctccacacctctctctgacatcctgcctcaatctcttgcttccattgttgcttcctaagccaggctgtattctctactacccgtatcagaaagatggccaatgccatttgcttctgttatctccaagtgatgatcatagatgcctggctgttcctctcaacgtgctctctcaggcctgtccagaatactttattcctttaaattgtgccttcattcaatcaggagttggaagtttgtggtgggg

SEQ ID NO: 109 - DNA, 599 bp, Homo sapiens
tcagcctaggattggtttattagatttctgtgtgtacatttccctctaccttcatttcttcatctctatcattgaaaactatcccttttgtatccccttccttcttagttgatttcgttcttaaaatttggtgggataaagtgattttcactgcaggattaaattatcagtcctcagtggcatttgattattagcaatgtactcctaaaaattaaagaattactgttctaacgggaaattttcaggtgtaaagtctgttcactgatagatcccacatcaaactgcaaagggttacacacytaagttagaacacatatgtgtatacacacacatctgcagtaaatactgcttactaattatgctatatttgaatatgtctgtatcttctatgctcctgggtgtctaaaacaacctgcttccatgtagaatcccatttattttcaaggccattgtcaaagctgcttctctcctcaacactttactctcatagtgatcagtctccaatatccactctgggacacctcatttttcttagcatctcctatctgctaccctgtctctccacacctctctctgacatcctgcctcaatctcttgct

SEQ ID NO: 110 - DNA, 599 bp, Homo sapiens
acagacaccaggggataaacaccagcccccacttctgaggctgctcaccaagctgaacttgctgcctgtcagcctaggattggtttattagatttctgtgtgtacatttccctctaccttcatttcttcatctctatcattgaaaactatcccttttgtatccccttccttcttagttgatttcgttcttaaaatttggtgggataaagtgattttcactgcaggattaaattatcagtcctcagtggcatttgattattagcaatgtactcctaaaaattaaagaattactgttctaaygggaaattttcaggtgtaaagtctgttcactgatagatcccacatcaaactgcaaagggttacacacctaagttagaacacatatgtgtatacacacacatctgcagtaaatactgcttactaattatgctatatttgaatatgtctgtatcttctatgctcctgggtgtctaaaacaacctgcttccatgtagaatcccatttattttcaaggccattgtcaaagctgcttctctcctcaacactttactctcatagtgatcagtctccaatatccactctgggacacctcatttttc

SEQ ID NO: 111 - DNA, 599 bp, Homo sapiens
ggaacactgaaacaatcaacaacacactgcacctgccatccaggagctccaaggctagggttaacactgaggccaactgacccaaagctgtgaccacactttcctgctgcaggcccagcccatcctggttatgaaaaccactcatttttgtccacagacaccaggggataaacaccagcccccacttctgaggctgctcaccaagctgaacttgctgcctgtcagcctaggattggtttattagatttctgtgtgtacatttccctctaccttcatttcttcatctctatcattgaaaaytatcccttttgtatccccttccttcttagttgatttcgttcttaaaatttggtgggataaagtgattttcactgcaggattaaattatcagtcctcagtggcatttgattattagcaatgtactcctaaaaattaaagaattactgttctaacgggaaattttcaggtgtaaagtctgttcactgatagatcccacatcaaactgcaaagggttacacacctaagttagaacacatatgtgtatacacacacatctgcagtaaatactgcttactaattatgctatatttgaatatgtc

SEQ ID NO: 112 - DNA, 599 bp, Homo sapiens
gtaataacaatagaaataaagtgcacaataaatgtaatgcgcctgaatcatccccaaaccaaccattccccgctcaacccctgcccaccctggtccatggaaaagttgtcattcatgaaatcagtctctgtgtcaaaacggttggggacagctgatgtagtttatatggaataacaaatctgaataatatgactctgtcgtggaaactttaaagacctataagagagtggtctgaacagaacttgggaaatctgaagcgagtgatgataatatccttgaaatttttgtttgtgccttatkcttgaacactgtttacttgtgatttccaaagacagctcttatctgaaatgttttctaaacactcgaatcagtcctgagttgactttattctatttcccatcaatgtacaaatgtgttacagtatatgtaaattagtgaggcttggtgtgctgagttttaagaaattccgttcgggtgcagtggctcacacctgtaatcccagcactttgtgaggctgaggtgggcggattattaggtcaggtgatcgagaccatgctggctaatatgatgaaaccccgtctctactaaaaatacaaaaa

SEQ ID NO: 113 - DNA, 599 bp, Homo sapiens
ctactaaaaatacaaaaaattagctgggtgtggtggcacatgcctgtagtcccaactgctcgggaggctgaggaaggagaatcacttgaacccgggaggcagaggttgcagcgagccgagactgggccactgcactccagcctaggggagagagcgatactccgtctcaaaaaaaaaaaaatgaaattccaaagtgcagctatttaaattatgagcattggtgcaccaaggatatttagctaaacaattgaccacagggctaagtattctaagcctgttgactgatcatgacttcacccragagcaaggaggctaattcagtagataattgattggaaaggaaaatgaagagtctctgatcttttctatagcttgaaaaaattagtttggctttataaaattttgacttatacataaataatttactgacgtgaggtacacatgtgggtgcttcacgggcacattctatgcacaatgggtctagccccagtggctgccagctctgagggagaagtctgtgggcagtaggttctccttgcttggtgtttgcagaaacagtgtccaatggtcaaggatggccattcagcccccagacatcc

SEQ ID NO: 114 - DNA, 599 bp, Homo sapiens
taatggatattcctacagcttcatcaaagaaggaaggaaagagctgctgatgggcagaaagcaaagatggtgggaaagagggtgtaggttctgaaagtatcaaagtaacagagatttatatgagattaaaaatagatgtaggaaagtaaagttggagagtttagggtagatgattatacacagaatttaagtttttgagtttaaaattcagttatgggtttcccaggttctgggctgtggcaggcagaataatagaccctgaagtttcccacatcctactcctgagttcctgtgaatacratatgttacatggcaaaaggaacctctaggtgtgattaaattaaggatcttgagatagggggatcaccctggattatctaggtgggcacaatgctgtctcaaggtcctcatcagagggagacagaaaggtcagagtcaaaaaggagatgaggtgagggaagcaaatgtgtttggctctgaaatgaagtggcacaagccaagaaatgcaagtggtctctagaagctggagaaagcaaaggcaaagaaacacattttccagcctggtgcagtggcttatgcctgtaatcccagtactttgg

SEQ ID NO: 115 - DNA, 599 bp, Homo sapiens
agcagctctttccttccttctttgatgaagctgtaggaatatccattattaaaagggtgcttgttatgggccagggatagtgccaagtactggagttgaatcatgtcatataatcctcacaacagctctgtgagactgtggccttgggtgagttaatttccttagttcctctctgcctcagattcctcatcatgaaatgggacagtaatggttcatccctcgtagggttggctgacaatgactgagtgagtgtgtgtacagctctaggatggctctagggacagtaagagttctgctgtratgaccatctcccactgctaggttcccaaacctcacctgcagcacaagctattcttctcccataattgtccatcttatttttcttgtcttcttggagaatgtcaactgagtctctcaggactccactcaaatgtcgctcctccttcatgcccccatggcctcttgtttgtatttctgattgctgtcagaattgcaatacatgtgtgtctctgtcaataacttgaaaggtttctggaaaggtttgcactgacttctgttcctcatctttgcatcttggatacctacaattggcacttggc

SEQ ID NO: 116 - DNA, 599 bp, Homo sapiens
gtggcaaactttgccaaatccaaagaaaaatagccaggatggtgaagtgtctagacttcttgttgtatgtggcatcaaaggagttgtttctgtctcagtgatgcacacaacaggcatgtaatgagcacctttatgtgccaagtgccaattgtaggtatccaagatgcaaagatgaggaacagaagtcagtgcaaacctttccagaaacctttcaagttattgacagagacacacatgtattgcaattctgacagcaatcagaaatacaaacaagaggccatgggggcatgaaggaggagygacatttgagtggagtcctgagagactcagttgacattctccaagaagacaagaaaaataagatggacaattatgggagaagaatagcttgtgctgcaggtgaggtttgggaacctagcagtgggagatggtcattacagcagaactcttactgtccctagagccatcctagagctgtacacacactcactcagtcattgtcagccaaccctacgagggatgaaccattactgtcccatttcatgatgaggaatctgaggcagagaggaactaaggaaattaactcacccaaggccaca

SEQ ID NO: 117 - DNA, 599 bp, Homo sapiens
gctaatggactgagtggggaaacccagcaagacctgtccagattcttcttggcctctctgttatatttccttttcctgggtagagggcagagggtcttaagacttactgtcagaccaaagaaggccaaagaatttatagccaactcctagacagaaaggcaggagaaggttagagtcatgcttctaggttctatggcttactttggggaaaaggattctagtttttatgatctgcctttgggaagagggagtctggtttctgtgacttgctttggggagaatggaggcatgaagcaggarggtcagagagatcttgctttttgaggctgctttgaggccttccaatgtcgttgagtttaaagtactcagcctgccaaaacaccatactttgggactgtttttggagcccaggagttccattgccttcagcttgtgctcgtgaatcacagtcacctgaattcctactgggcatctgccactttcctggtcttatgctctggctgatcgggtggcgtctcctcctactgctgacaacctctatgccattttgactctgatagcctcctaggtaggctggccatgtcaagggcatgcactaa

SEQ ID NO: 118 - DNA, 599 bp, Homo sapiens
cctactgggcatctgccactttcctggtcttatgctctggctgatcgggtggcgtctcctcctactgctgacaacctctatgccattttgactctgatagcctcctaggtaggctggccatgtcaagggcatgcactaagatgttgtcttccttccatgacctacatgggactgcacccttcactttacaccagttgtgcaaactcagggctgatctggatttccaatgatataatttgagtgttagtagacagcatcctttgctgaagatgtacttcacactgccccttctcaagtctyccatgtaagtttctgggggaaaaaatggatccagagaaaggtagtcagtagcagttttccccctcacaccgaaattgcctcctgccctttgtctttgaattcaagccggtgttgcttcttactgtcagacctgagagttagttctttccctggatacatctcagctcctcctgcctgtttgccaacattccaggcttgcccagagactccaaatcccaggataacccagacctgactctgaactccggagtccactgtgctggtttcattctcctgttcttgctcacatatctgcccac

SEQ ID NO: 119 - DNA, 599 bp, Homo sapiens
gtatttttagtagagatggggtttcaccgtgctggtcaggttggtctcaaactcctgacctcaagtgattcacctgcctcggcctcccaaagtgctgggattacaggcgtgagccaccatgcccggcctaaattttcatatttagaaatgaccatagagagagttaaagacaagccacacacagcacaacaaaaaccttagtctacagaccacaggcagttccactgtctcttgaactttaaaatgttgccacttttaagtcaggttaaaagtggcaacattcaaaaaatggcactcttytcttagttttgtaatgttattcagtaaatatgaaatgtgtatccagtgtcattcaataatgaatcatatttacgcttggaaggctctattatgtcccctacttataaatgcagaatatatgtatattgaaatatacctaattccactgcaacatggttaagctttggtccaagaagaaccggaactatattactgcgatctagaagtgacaaaagaaaagacaaatgtattagtgttgccttgagcttctttatgacaagcatctatgataatatgctcatttcatgtaacaaagattc

SEQ ID NO: 120 - DNA, 599 bp, Homo sapiens
acttaaggcccacagtatggtatatcttgctgaatgttccaagtgcatttgaaacaaaggtatattctataggtttttgttttattattctttaaatgtctatttggttaagttcattaatggtgttgttcaaaaaatttatatcctgactaatcttttatctgcttgttccatgtgttgctgaaagagatgtgaatatctccagctattatggtcaatgtgtctctatctcctttagttctgtcaatttttgtcttacatagtttggagctatcttatatgcatacacggatttatgcycgttgaattaacacttttatcattatgaaatatctctctttatctatcataacacttcctctctcaatgtgtagctctgtcatatgaaataatcacacaagttttcttttgcttggaattggcatatttgtctttttttaaacatccctttactactaacatttttttttgttctatacataagtgtctctcataaactgcatgtatttgggtcttttttgaaatatggtcagtatggtgtttagtccatctgtatatttaaaattactgttacagttgctatatcatatatgcatgat

SEQ ID NO: 121 - DNA, 599 bp, Homo sapiens
taaataccctcaatggccttctcatggaccttcttttccagcttagatcttggcaatacatttctgcataatgcgtccacctagggtatggccactataattataaaatatgtccattataattataatttaaactagcccaaaatacacatcagccacccagtgtttttaatatgatgttatatataatatatatgattgttatatggtatatatcatgacatatatattacacatacatacataattctcatttctttctcttcatgtatattaggatccgatccattttcttccccraacatccaataaattacatcctcttcattcagcaaagcagagcagttgagccttacgttttttcctggtaaaagttggcaactaaagttctgatttttgaaactcaggtttcttaaaagtttcaaaacaatataatcaatgtatgttaacctaaagcaaaacgtggtgctccatcccagaaagagaataaatatgccttgctttaaataaaacaaaatatataaagcagaagaaataggtagcaattacaagtcatcatcaaaacatgatttggcttctttttaaacatttatttttta

SEQ ID NO: 122 - DNA, 599 bp, Homo sapiens
ggagctgggttctggtgtggaaaatgagaaagtggccatctttgaaatgtctctcagtagcaatgagctaagtttcaaaacttccaaaaataaatctttctcaccttttctcaccaagatgaagcttttggtgtctgtgcctcccgtgctggccacagtgcaattatataaaacatttagattgctttcaccaatattttcaattctcaatacttttgaagcatgccatttgccttctggagtcctgtaagagggcaaaataatttagcagtaggctctgttcgttacccttgagagggkaattcacatgtttaaaatgcttgaaggcagctgtgatgttgcctgcattatttcttccctttctggccagtactcttaaagcatggactacaataaacgtcccctcctccgtggagcatcagaactgacagaaacagccctcctgaggccatttgggaatggtgctgtcaattacctgaagtttaaatggctggaagatcatgatgctaagttgaaaatataagaaaatattctctctcaattatttttctctacttctctcttcctaacaacttggggttctttccacagagtggttc

SEQ ID NO: 123 - DNA, 599 bp, Homo sapiens
aaaaattactttattctttttattcctctgtattatctcagattgtccataataaacataaacggaatcaatctagaaaatgtatttttttccaaatgatacttttatacaaagaatttgctaaaattccaagagctgtgtgctgtattaactactttttgtgtaatatttcatttaatcttccccaaaggagcagccttgtaagtgaagcagttagtatcttcattttacagatgaaggtaccaaggtttaagggcattcacgatttttcctacaatacaaaataattgatggagcccrgctgcaaacccagacaaatgtcaatccagtgctctctctcttctctcaaaactatgcacctcaacccacttgctaatatttctgtgagtccctatgtgtttcagcctagtatctcttcaccccagaaatctgatttccacgggtacggatagaatacattactgtgtaatgttttcacttcagttctctaaatatccgtgtacacatttttattctttaaaaatctgagtagaaatatcactactccagactaaaggcaggaatgtggagtcactcagtggaatgtgtcagcacgtggg

SEQ ID NO: 124 - DNA, 599 bp, Homo sapiens
ataattgatggagcccagctgcaaacccagacaaatgtcaatccagtgctctctctcttctctcaaaactatgcacctcaacccacttgctaatatttctgtgagtccctatgtgtttcagcctagtatctcttcaccccagaaatctgatttccacgggtacggatagaatacattactgtgtaatgttttcacttcagttctctaaatatccgtgtacacatttttattctttaaaaatctgagtagaaatatcactactccagactaaaggcaggaatgtggagtcactcagtggartgtgtcagcacgtgggttggcaactactgcattagtgttagcagtaaaaatggacaagcacgtgatgatggacaacactggtaagatttcttgattattttcttttcctttttccctttcttttctagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacat

SEQ ID NO: 125 - DNA, 599 bp, Homo sapiens
ctcaaaactatgcacctcaacccacttgctaatatttctgtgagtccctatgtgtttcagcctagtatctcttcaccccagaaatctgatttccacgggtacggatagaatacattactgtgtaatgttttcacttcagttctctaaatatccgtgtacacatttttattctttaaaaatctgagtagaaatatcactactccagactaaaggcaggaatgtggagtcactcagtggaatgtgtcagcacgtgggttggcaactactgcattagtgttagcagtaaaaatggacaagcaygtgatgatggacaacactggtaagatttcttgattattttcttttcctttttccctttcttttctagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacatataatgctggaatttcttaccttatgttctcattaagaaatcagataaataggcattaatc

SEQ ID NO: 126 - DNA, 599 bp, Homo sapiens
ttgtcactgtgtcagtgacaaaacaggcatcaacatgtaagacaattaaatgagcacacttttttaaagggcataattttcttatgatgtaatggattgcaacaaactgggaagacgatttcatcaaatatgggtttatattacatacaatatagctttgctcttacctatgaaaaattagcttttcaactattaattgctttcaaattccttattttaagcaattcttttaatataaatatgctaattttattacaatatattttaaattcaggttttaaaaggtttaggggacttgasaattgacagagtaaagtattcaaaaaaaggaatttgaaaactaatggtaatgtttttattctctatattcaaacataaaggaaaattataaaggaaattataattcaagtggatatttgggacttcaaggagtaagttaaacaaatgttcctcaaactatgcttggtgaatgaccatgttttaatttaaatttgcctttttttgttgttgtttattgattagtttcatttccaatccttcagaaaccaatactgaacactttcttagatattgcagcagtattaaattgtgataaaagt

SEQ ID NO: 127 - DNA, 599 bp, Homo sapiens
atatccacttgaattataatttcctttataattttcctttatgtttgaatatagagaataaaaacattaccattagttttcaaattcctttttttgaatactttactctgtcaattctcaagtcccctaaaccttttaaaacctgaatttaaaatatattgtaataaaattagcatatttatattaaaagaattgcttaaaataaggaatttgaaagcaattaatagttgaaaagctaatttttcataggtaagagcaaagctatattgtatgtaatataaacccatatttgatgaaatygtcttcccagtttgttgcaatccattacatcataagaaaattatgccctttaaaaaagtgtgctcatttaattgtcttacatgttgatgcctgttttgtcactgacacagtgacaaccctagtggaagcactagctcttacttaactagtagatagttatatttgatagcagtttaagaaaagtttgagggggaacctacttactgattgataactggttttatttttaccaacatttcatacctttgatatttatgtaagcctgaaatttttaccaacatttttcatctttcaatgca

SEQ ID NO: 128 - DNA, 599 bp, Homo sapiens
aattttatttaagtacaaacttaagtgaatgtcgtaagtaatgagtatagaatcattgaaaaaacaaattatatataaagttgtttatatttaaacctcccatgctaaccaagcaaccaattagccaatgtgtttttaagcatctactttaagatcccactgcttgacaccacagaagaatacagagatatatgagccatagatctgggcactaaaggaacttaagtctttaagttccttagaaggccaagagcccaaaggtgtcctcattccaggagtggaaagaaaatctcaccctgktttactcatatcatttaattctaccaccatcacaatttctatgctcagaaagacccccaagaaggtgaaaatgtctcctaaataacaaagaccatgctcctaattgggtaattaaaacatgataccactctctcttctagcttcatccaatctatttttaaaagcaaagcagatgcatgcaacaacttggaaaaagttacagacaacacattagcagaagaaaaatagcataacaaaaaaagaataacaaaactcacagacaaaataacctggccagagaataaagagtgatcccgatg

SEQ ID NO: 129 - DNA, 599 bp, Homo sapiens
caataaaaacccatgcattttctagtaataattaacccgtgtttatttctagtaagagttactagtgaggattaactagtccacacatcacatgttaaattaggaactgctgctgtggtacagatattctcaccgtgggtcatttctaaataaaggcttcatgataacgccagctctgggcccggttctgaaaaggaaatgccctctccctttccccaaagtttcagagaaccgtgaagcacaaagaacagagcccaagagaagagactattggaagctcattagtttgttttctcactrtcgattgttgacttacgtggttatttcttgcttaaaggaccttattcatttgtttttaaggaaaatgggatagctctctgggggctagctcattcattttttaaaaagaaactatcttgaatatttttctatctggcattccctcttacctcctccaggcactacatccctttcaaatatgcataacttatacccaaaatgtttctccaacaccctgggcaaaatctccacagcaaaggtgtgctcctctccattttcaggtcggcattcttttaggtaagacacaaaagcatcatatg

SEQ ID NO: 130 - DNA, 599 bp, Homo sapiens
taatgagcttccaatagtctcttctcttgggctctgttctttgtgcttcacggttctctgaaactttggggaaagggagagggcatttccttttcagaaccgggcccagagctggcgttatcatgaagcctttatttagaaatgacccacggtgagaatatctgtaccacagcagcagttcctaatttaacatgtgatgtgtggactagttaatcctcactagtaactcttactagaaataaacacgggttaattattactagaaaatgcatgggtttttattgtgttgatattggtgaygaaatttaagtagaaaataggaaaattgaaaagggaaaaataacaggaaagcggtgatccccatcagatcatagctatgaaattcaatgttttttttattaatataggaatacaaatggccatagtgcctatattaaagcaaattactgttaaatttttctttttaatgagtaacatttttagattttctctgaagtctttagaacaaacatttaaaatctggtgtcaaattattctggatactgatgcttaaaaaaaaaaaacaaatgtttgattattaccatcattcatgtattaat

SEQ ID NO: 131 - DNA, 599 bp, Homo sapiens
aggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgkggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatg

SEQ ID NO: 132 - DNA, 599 bp, Homo sapiens
agccagtcctagacagcccgcttcccctccgcaggcccctgccctaggccctcttagcctaaattgtcggccccagaaaagtgcctgcagcctccaagatgctcatctccaagaggaggccgtacgccatcctgtgccaacctggtcagaccgctcgtgtgcaactgtgaccaagtccctggacttaccatgcctcaagttcctgggtttggaatacgtggggcctaaggcttctcactgctttgagaagatatagctctaatgagtaaatgcttctaggacatgacagacatgtaagargtgtttcttcacgtgccctagaaaggtagttgtgctgattctctaaaatagacttcacagtttaagggcatctgaaccatggaaaagaaagctgttttatacctgaaaagttatttgttggtcctggttggggaatgtttaaaccagaattttaaaatatgcccattaattaactgacatatgaagacttaccatgtataagtccctgtgtttagtattgagtggcttgtgagaaacagaagagaattagtttgctcctggatggaaggtgtgaaacaagaaggtaggtgcaaggcaat

SEQ ID NO: 133 - DNA, 599 bp, Homo sapiens
cccttaaactgtgaagtctattttagagaatcagcacaactacctttctagggcacgtgaagaaacacctcttacatgtctgtcatgtcctagaagcatttactcattagagctatatcttctcaaagcagtgagaagccttaggccccacgtattccaaacccaggaacttgaggcatggtaagtccagggacttggtcacagttgcacacgagcggtctgaccaggttggcacaggatggcgtacggcctcctcttggagatgagcatcttggaggctgcaggcacttttctggggcygacaatttaggctaagagggcctagggcaggggcctgcggaggggaagcgggctgtctaggactggctctgaggaggaaaagagagtgagagggatgctcaggattccttataagccattaaaaacaaataggcattcaagttcagtgcagggtgaaagagcacaattgatggagcacatccgcccactgtggcctctgctgagatacagagagttagaacctccggcatctgctaggagcccccggcctgtgttgaggcaaatgactcgccagttgggtttgctggggctctcagcga

SEQ ID NO: 134 - DNA, 599 bp, Homo sapiens
caggttggcacaggatggcgtacggcctcctcttggagatgagcatcttggaggctgcaggcacttttctggggccgacaatttaggctaagagggcctagggcaggggcctgcggaggggaagcgggctgtctaggactggctctgaggaggaaaagagagtgagagggatgctcaggattccttataagccattaaaaacaaataggcattcaagttcagtgcagggtgaaagagcacaattgatggagcacatccgcccactgtggcctctgctgagatacagagagttagaacctycggcatctgctaggagcccccggcctgtgttgaggcaaatgactcgccagttgggtttgctggggctctcagcgaggagcagaaaggagacagttgtccaaagagaggacattagcaaaatcagtgccccaaaccaagttgaatcatagctgtaaatactcagaggaattaacctgtcaccttggtctgaagttcagctgtgagggaggggacccagggttagcagaagccatctgagcagaagctgctctgagcagtgtgaccttaagcaatgcaaggatcttcaaagagtgaccaag

SEQ ID NO: 135 - DNA, 599 bp, Homo sapiens
tgtaaagttaaagcagccaagtgctctctttttctctctttgcttaatatgaacttgaattccctcttggccatactttttctaagtttcacaatttgaatgtaataatatgataacactgaaaatcaagagaaacaacttgaaaagtcagtaactggtttgcaactcactgcagaaaacaaatgtaactttaacatcacaacttccttttgatttttaaaaaaatcaacttggttatcaccattactcatcagccttagctcaagtgactttggtaatttcaaaaacacatgactaaaraatgaaaatgtaagggtattggctattttgtgccttggtttgtgagtttctaaagatgaattttaaaagtggtttgattcaagaaaatcattatagaaagtgtgtgatctgcttacatgcttacttccaagaggacagctctcatataaatgcttaatttcatgtatatttgttaaaaaatgcaagccagttatggatcatatcttagtaacaccttcattcatcttttaatttcattctgtacacagtgcacatgatcactgagtagaaataaacaatgtaacagaatcttgaaagtt

SEQ ID NO: 136 - DNA, 599 bp, Homo sapiens
atgtttcataataaacattttaaaatgtaaagttaaagcagccaagtgctctctttttctctctttgcttaatatgaacttgaattccctcttggccatactttttctaagtttcacaatttgaatgtaataatatgataacactgaaaatcaagagaaacaacttgaaaagtcagtaactggtttgcaactcactgcagaaaacaaatgtaactttaacatcacaacttccttttgatttttaaaaaaatcaacttggttatcaccattactcatcagccttagctcaagtgactttgstaatttcaaaaacacatgactaaagaatgaaaatgtaagggtattggctattttgtgccttggtttgtgagtttctaaagatgaattttaaaagtggtttgattcaagaaaatcattatagaaagtgtgtgatctgcttacatgcttacttccaagaggacagctctcatataaatgcttaatttcatgtatatttgttaaaaaatgcaagccagttatggatcatatcttagtaacaccttcattcatcttttaatttcattctgtacacagtgcacatgatcactgagtagaaataa

SEQ ID NO: 137 - DNA, 599 bp, Homo sapiens
tttgatcatttcctaattttgttgttgtgattttctgatatgggaaggtgttccaggcttgttcttttcttagtcccggacaaagccatttctctaaggagccatggttcctttcagtgagaaattgttttcggagaccacaatttgggtctaacagttgcacactcttaactgagttcatcaatgtttctaggctttctgagtagatataataaggaaatacatatacatccataaaatgaattataaattaatactgaaaatccaatttaaatttaggaccgcaggttttacttagcytcatcaactttacattggaatcactgccacgcagaaaattccagttcccagtggcatcaacataattgttaatttgctttatccctcaatgtacatatatccaaaaggcatatattgcagaagaattataataccaacacatcctttaatattttgtttcctaaaaatagttgaaaacatttttgtactattttatcccttgagaatatttcactagaatatagagtcatcattgtattctaaagttatttgaaattattcctcttattgtggttttgtcagttaaacatatttatttg

SEQ ID NO: 138 - DNA, 599 bp, Homo sapiens
tttctgatatgggaaggtgttccaggcttgttcttttcttagtcccggacaaagccatttctctaaggagccatggttcctttcagtgagaaattgttttcggagaccacaatttgggtctaacagttgcacactcttaactgagttcatcaatgtttctaggctttctgagtagatataataaggaaatacatatacatccataaaatgaattataaattaatactgaaaatccaatttaaatttaggaccgcaggttttacttagcctcatcaactttacattggaatcactgccacrcagaaaattccagttcccagtggcatcaacataattgttaatttgctttatccctcaatgtacatatatccaaaaggcatatattgcagaagaattataataccaacacatcctttaatattttgtttcctaaaaatagttgaaaacatttttgtactattttatcccttgagaatatttcactagaatatagagtcatcattgtattctaaagttatttgaaattattcctcttattgtggttttgtcagttaaacatatttatttgttttgttctgatttttaggaattgattttta

SEQ ID NO: 139 - DNA, 599 bp, Homo sapiens
attatagatttaaaaatagctagaacagagggttttaaatgtcctgatcacaaagacaataaatgtatgaagtgatggatatgctaaataccctgatttcagttttaataatgtacacatgtatcaaaacatacagtgtaccccacaaatatgtacaatcattatgtgtcaatttaaaacacattgaccaatggaacagaatagatggtccagaactaggtctaataggatatggaaattgaatagacattaaatgggcatcttatgttagtgggtaaaaaaatgaactttttaagaagwggtgttgtgataaatacacagacatatgaaaacaatgcaatggatccatttctcagactaaacaccatagtaaattccaaatggattgaagatttaaagtgaaaaatgagtccatatctgtattgaaagaatggattaattcttttaaaatctaaaagcaaagaaaaaaaactggaaaacaattgcaatttacatcacaaagtcttaatatgtctaccatgtaaaaaccttcccacaatgataatgaaagagatcaaaatctctgtagagaaatgggccaaagctaaggcacaagcact

SEQ ID NO: 140 - DNA, 599 bp, Homo sapiens
cataatggctgtactaatttacattcctaccaacagtatataagagtttccctttctccctgtttgtaccagcatttgttatttttttatctttttgataattgccattttaattgaggtgagtttttatctctttgtagttttgacctgcattttcctaataattagtgatattgaacatttttttcatatacctgttgaccatttgtatgttatcttttgagacatagctatccagatattttctccactttaacagtattaattctaatccatgaacatggaatacctttgcaatawtttgtgtggtcttcaattttttaaatcaatgttttatagttttaagtgtggagattttttgcctccttggttaaatcattactaagtattttatttctttcgtagctattgtaaatgggatcgttttcttgattcctttatcagacagtttgctattggggtataaaaatgttatggatttttgtatgttgatttcatatcctgcaactctactgaatttattagttctcaccattttttagtgaattctttggcgttttctatacatattatcatgctgtctaataaacagggataat

SEQ ID NO: 141 - DNA, 599 bp, Homo sapiens
aaatagagaaaaaatagaagaatttgcaaattagtctaataacatttttggaaataagaaagcatctcaaaatagaatgatatgaagctccagattgaaagagcccaccaattaattactcagcaaaatggagacagaactgccttaacattttggaagaaaatattatgtattgcctaaatttctctactgagtcaaacaattattcaaatatgagggtaaaatagatattttcagacaagtaaggcctcaagatatttcctgccatgtccctttgtctgagatctcctggaagaagcrgtcctccataaagggaacatatagtactttgggcttcagggaaatggaatccagctaaggaaaatggtggaaggcatctccagatctccagactgatgataaatggaaatccaatgctggaaattgtgcatttgccatatttaagcagaagagcaagttctaggtagatggtctttaggaaggagatttcctaatgtgttgaatgcattgaaaatgcattaatgtgagaatgcattaattttccactagaaatacatttctagtggagaatttaaaaaaatattaatgaaagatataaa

SEQ ID NO: 142 - DNA, 599 bp, Homo sapiens
aaatgtcttcatatgtaaatatatggtctaaattatgtgggtcagatactaggtttgctaaatgttttaaggttataaactacttttttagcttttgagaaccatttgatttgtatactttacaatttgggaaggcttgtggacatatggaattgcccacccctttaactatgctggaaagagtaagaccttatctgtgaatagaacataattaaaataacttaccagaggccagtctgagggctccagtgcccaagtagaggcagcaggtggctcccaaggcctgggccagccggcctycttcagtctgaaggccacgcccttcttcctgctgctgtccagttgtcttttgactgccacatatggacccccaaagatctccaaaggaaactttcctcattacaggaggaggtggctattttggtttccacctgggccatgctctgaaccaaaagggagtccacgtaattctatttgacatcagcagtcctgctcaaaccattccagaaggaatcaagtttgtacatggagacatccgccacctctctgacatagagaaagccttgacacagatgtcacatgtgtgttccatattgcct

SEQ ID NO: 143 - DNA, 599 bp, Homo sapiens
tatgtaaatatatggtctaaattatgtgggtcagatactaggtttgctaaatgttttaaggttataaactacttttttagcttttgagaaccatttgatttgtatactttacaatttgggaaggcttgtggacatatggaattgcccacccctttaactatgctggaaagagtaagaccttatctgtgaatagaacataattaaaataacttaccagaggccagtctgagggctccagtgcccaagtagaggcagcaggtggctcccaaggcctgggccagccggccttcttcagtctgmaggccacgcccttcttcctgctgctgtccagttgtcttttgactgccacatatggacccccaaagatctccaaaggaaactttcctcattacaggaggaggtggctattttggtttccacctgggccatgctctgaaccaaaagggagtccacgtaattctatttgacatcagcagtcctgctcaaaccattccagaaggaatcaagtttgtacatggagacatccgccacctctctgacatagagaaagccttgacacagatgtcacatgtgtgttccatattgcctcttatggtttg

SEQ ID NO: 144 - DNA, 599 bp, Homo sapiens
acaggaggaggtggctattttggtttccacctgggccatgctctgaaccaaaagggagtccacgtaattctatttgacatcagcagtcctgctcaaaccattccagaaggaatcaagtttgtacatggagacatccgccacctctctgacatagagaaagccttgacacagatgtcacatgtgtgttccatattgcctcttatggtttgtcagggaaggagcaactaaatcaaaacctgatcaaagaggtcagcattgggagtacagacaacatcctccaggtttgccagaggagggggktgccagagaagaaggtgctggaggcgaagagcacacccctggacagaggtgatggtgtcttaagaacctgttctctgaggccggctggcatctatgggcctggagaacaaagacaccttcccagaatagtcagctatattgagaaagacacgttcaagtttgtctgtggagatcctagaagcctggttgagtctgtccatgtggataacttggtgcaggctcacattctggcctcagaggccctgagagctgacaagggacatattgcctctggacagccctactttgtctcagatggc

SEQ ID NO: 145 - DNA, 599 bp, Homo sapiens
tggcttaaaacgttgctgatccttgttttccagaggcaaggaaacttattttgagttatctacagtctttaataattgagtaagctatactcttctgaacaaaatttggagcgtatttgtttctctctctgcctggcttctcctgaatttggaaactatttgtaagtattcttaccttgcggcaatacagttatttgcatcagtgtaataaaagtccattttcttttgcaacaggacacaattggagaaactggttgtttaccaaggctttgactggaaggatatgcttccacttaaggwatctggcttgacttgaagagccaataaaagccccctaggaaaactggcctcattccttgtctacaccatccctgcacaggattcctaacctgtgatgactaaagaatgtcattttctaacgggccctatgtttttgggacttaaagaagagagaaattcacaaaactcataggtgtttgagggtacaaacccacggctaggctgggctttaaaaggtcttatctgagatttcttgtggaacagaattccctcaaagccaatttaaaagcctatgtgaaaaataattattcttgctgcac

SEQ ID NO: 146 - DNA, 599 bp, Homo sapiens
aagaagtacagcaatgagagatacgtggtgaaacctatttcactggggattcaatccaaattttaggaaaataataaaaactcaaaaacaattaatggtcagggctgcgatctaataacaggtatgctataatcttccttggaaacataattttactctctccagtttcccatttctaccaaagataaatcttactaggatcaatttacttgtaaaataagatatagtattatacttggtctgattatttgcataaagtgcaataagaatcatgattagacctataggctgttttaagtwggctttgctggaactttcacagggcattttggattacacttttaaaagcctcgaggttaggaagccaagccaagaatttgccaccaggatgtacctgtgatacctgtacaaattgggtaaattcctctcttcttgaggttccaacatgtcttgaggaccctagagctgtcagaaaatggtattctttacttactgcaaaattagaaaccttaaaaaggaaccatgtacataagttactatgccatccttttcaagaggcttttgattggttctataaagtcaatttcaattcttcaaag

SEQ ID NO: 147 - DNA, 599 bp, Homo sapiens
gaagtactgctctcttacctttatttcctgctcttaagacataaaaaaaagaggaaggaacttcaagtccttatttcagtaactgccagcttttgtatctgaacgaaaatatgtgaaaatatccattttcaaagggttctactatatttcttcctatccagagagatacctggagaagacacaatagccacgttacaccagctcaaaaataaaggattataactggaggaaaaaggaaaaccttattttgtaaatgaccatggacattgtgaaatggatggtcatacagaggaaaatcarataaactacctctttcagtaggaagtgctctgaagaagaagcatctcaaactcttctctgaccaacctccttgatgagataaagtttgtggttgggtttagttgaaagagtgagtaagctggtttcctttacaggaatttcctgtaaagaatattaactttcaactcaatttctcaactgtgggttttggttttcttcttgtaaaactaatctctaaaagtgtgacctttgagataaacactaaagcctattttgtgattaactttctaattttgaaaaagaaaaattatgtctccaac

SEQ ID NO: 148 - DNA, 599 bp, Homo sapiens
aaaaaatgagttgctaatacaattacttttcaagaaatattttagaataacaaaatgggttatttactaacaaaatttacatctccatatatacggagtcttcacttaaaaaaactgatggttataaaataaacccgtttaaagtgctttgagcattttacaggaagggctaagagcagagagattcaagatatttgccaaatttgaatgcccatttaaacttaactgtaacatctttgatggcaggtactacagcttcattttctgttatccctagacaatggggtctaaagccaccayggagcatctgagaatcataatgatattagttaaattaaatactgtcactattacacgagaccaaatctctgtctgcaggtgttctctgtgtaaagtagtttaagtctgcctttgatggtgacatttctctccctgggtctcagatccctgttgacactgctttctccagcactttcctctctctcccccgtttctcaccaaaaagttttgtgggtaaagtttagttcattatttctgccagagacagctgaaggtgtagccttgaccaactgaaagggaaatcttcatcctctgaaaaa

SEQ ID NO: 149 - DNA, 599 bp, Homo sapiens
aaaactgatggttataaaataaacccgtttaaagtgctttgagcattttacaggaagggctaagagcagagagattcaagatatttgccaaatttgaatgcccatttaaacttaactgtaacatctttgatggcaggtactacagcttcattttctgttatccctagacaatggggtctaaagccaccatggagcatctgagaatcataatgatattagttaaattaaatactgtcactattacacgagaccaaatctctgtctgcaggtgttctctgtgtaaagtagtttaagtctgcytttgatggtgacatttctctccctgggtctcagatccctgttgacactgctttctccagcactttcctctctctcccccgtttctcaccaaaaagttttgtgggtaaagtttagttcattatttctgccagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatgg

SEQ ID NO: 150 - DNA, 599 bp, Homo sapiens
tagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccaggtatgtgattatcattgagaatgggcactgccattccaagcaatgtgagccttggttgtccatctgtaatatgagaargacagcaccccgcttcactttacagaaagtaaatgagtgccacattattttattcccataagcagagtctgaagcttgctttggcttaagttgcccagtgctcaataaatgatgtactctgcattttggtggctccttccgattcggtgaagcattttagtgacggcagcatggaagacatcacttagacattagatggccttcaaaaggtagatattaacaagcaagccacacagtgtgggtgtgttgtcccacataaatgagacttccagaatggtcttgggctcatgttggtcagt

SEQ ID NO: 151 - DNA, 599 bp, Homo sapiens
ctgcctactgatgcacccacccaccaactggcctcagacctccagctgcctggggctgattgcaggctgcagctatcactctgggacagtgtttctcaaatcatcttgattataagaatcacccgaaacccttattacaaatgcagatttttgggcttcctgaggacttattaaatcagattctcaaggagaagaacaatggaacctacattataaacaagtgtcagagccaccacgctcatctgggagacacttttgggaaaccctgctcagggataagcatagagcttggggaggtgrgttagtgctgagttacagtagctgttgccagcattgtaggcaactgaccaacatgagcccaagaccattctggaagtctcatttatgtgggacaacacacccacactgtgtggcttgcttgttaatatctaccttttgaaggccatctaatgtctaagtgatgtcttccatgctgccgtcactaaaatgcttcaccgaatcggaaggagccaccaaaatgcagagtacatcatttattgagcactgggcaacttaagccaaagcaagcttcagactctgcttatgggaataaaataatg

SEQ ID NO: 152 - DNA, 599 bp, Homo sapiens
tactgtgtggctccaattaagtcacttaggctctttttggacctcagctttcttacctgcaaaataaaatgtctggactgtatcagtagttcctccaccttagaatgagggaatcagaatttctgatgtttaagtcgggatatttgtaatttttaaaaaagctccctgacttgtaaatcataagatcagatggttgctaagatcctcccagctctaccatcccgcaatttatgtctaaatgtccaagcctatagcaaattagttaccacgatgcccagcagtctccagcactcaggaatktccgccaaccttgagatgacagatactgcctactgatgcacccacccaccaactggcctcagacctccagctgcctggggctgattgcaggctgcagctatcactctgggacagtgtttctcaaatcatcttgattataagaatcacccgaaacccttattacaaatgcagatttttgggcttcctgaggacttattaaatcagattctcaaggagaagaacaatggaacctacattataaacaagtgtcagagccaccacgctcatctgggagacacttttgggaaaccctgctcagg

SEQ ID NO: 153 - DNA, 599 bp, Homo sapiens
gaatgccacggataggtgttaaggtcactgcattatccccattgctgacaactgacagctcttcttacaaggactgcaaccaaggaacaaggcaggatcagcaatggcctttaaagatgtggtctccccacttgcctttcccttgtccacaaagtctccgaaagaacagtcctccaactccaccaccagacacatcttcctaagcagcaagcctgggcatttcatttccatgcccaaaacgtcaccggctcccaccacccatgtgatgaagcacagattccagagcaccatggacaaaaygctgtagcgtttggctctctcatgtcttccctgatttcttcctcagagagtcgttccctgaccacctggataaagaagcgccctctcccttcttgccatcaaccatctctcttgctactcattttaaatgacttttgtcttagcacatattattgtctgaaaatatcttactcctaaaacttctccccaactagaatataagttccatcccagcaggaactgagtttgtctttctgagtcctgcagcctctctgcaggaatagtgcctagctgataacaggagctcagtaatgacttgt

SEQ ID NO: 154 - DNA, 599 bp, Homo sapiens
ctcctctctctccaccctgaagctctccgttatctcaccccagctgcacatgctgagcttttggtggccaaaccaagactctttggtggacacttttcagtccttctcatgcccaactcctctgcagcttctgaaactgatgtctagtctctcctccaagctttctctgtctggattgccaaggtggtctctctgctctgctccttgcattccttttaggtttgtcattctttattttccattagccctggcctacttttaaaggttgaggttcctcagggaagttcatctgccctcccytatggggcaacagaaacaatccaggcttgttacagatgccccaggctccctccagctgctgaaactgagaccctgctctgagccatatgcctccccacccctctgccctgggaatgctccagctggatccccaagatatttcaagtaagtggtttgaaaggtcccatgactgccttatcaagagaggggactcaagtcctttggacacagcccagatctgattctctggaggggacctgctccccctttcatatttgagagttgatagtggtgccatccagtgacaattttccctcttg

SEQ ID NO: 155 - DNA, 599 bp, Homo sapiens
aggtggtctctctgctctgctccttgcattccttttaggtttgtcattctttattttccattagccctggcctacttttaaaggttgaggttcctcagggaagttcatctgccctcccttatggggcaacagaaacaatccaggcttgttacagatgccccaggctccctccagctgctgaaactgagaccctgctctgagccatatgcctccccacccctctgccctgggaatgctccagctggatccccaagatatttcaagtaagtggtttgaaaggtcccatgactgccttatcargagaggggactcaagtcctttggacacagcccagatctgattctctggaggggacctgctccccctttcatatttgagagttgatagtggtgccatccagtgacaattttccctcttgcatgtggggcagggagaggtaggtggcctctattctctaatagaatagactagtatatgcaaacattctcaaattttataaataggagctatatctctagctttcctaaccgtgaaaaatctgacagttttattcaacttgggtcattttttcaggaaaagttaaacataactcttttcaa

SEQ ID NO: 156 - DNA, 599 bp, Homo sapiens
gccctgagtatccccttcatttctgtaaatcaagaaatgggaaatgaagaagtcagaaccagtgaacaaagtgcatctcacacaggaagctttgaaagggcaggtcctacccaaaccggccttcacttgcctataacttacgtgagtatttccaatggtgtgtagcaaccttttcacttgtgtcatttcttacaaatcatctcaagctcccaatatccctaggctctatgcagtgtgttcttttaatgccatttttcccctcattaatcttttttctttgatgtgctcacctagcatgtrtatttccatgagtaatttgaaaagagttatgtttaacttttcctgaaaaaatgacccaagttgaataaaactgtcagatttttcacggttaggaaagctagagatatagctcctatttataaaatttgagaatgtttgcatatactagtctattctattagagaatagaggccacctacctctccctgccccacatgcaagagggaaaattgtcactggatggcaccactatcaactctcaaatatgaaagggggagcaggtcccctccagagaatcagatctgggctgtgtccaaagg

SEQ ID NO: 157 - DNA, 599 bp, Homo sapiens
tgggctggatatttctttggcttgttgcaggagagcgaattaaaggatttaatatttcaggtaggggttttcacttttcatgttagcactgtgagtctgtggtcaagtgtaaagtgatggataacctgatatatcagcagtgtgatatattaatacaaacctttccatcctactattaaaaggggactgagaggagaattattagggtgaacagctttcagctgataccaagcattgtcgaggtaccctgttactgtagttgagtgttcagtgagatcagctgacgagggatgagccagmgttctaccatcttttccaggaaaccagggctgctgctggtatgctggagtccactgggagggaattagaacaggcacttcctttcccctacaaaatagacagtgaagaagaaagacacacaaggaagctagatctcttgttaaatcaagtactagatgtaaatataagctagaattccattttctaatgtgtttccatgtgctttgtttattatgattttcaggttgttccacaaaaaaactcctttggacatattctacaaggagtgaagaggaatttgtcttattttgtgatttacc

SEQ ID NO: 158 - DNA, 599 bp, Homo sapiens
tgtgttgagtcctcccttcccctttgcaatgcctgttgctttcctaagacagtgaaaatgagtgaacctatcttcctacattagcagatgttagtaggtttatgtctaacctcatgtgtaatatacttgaattttagaagtttctctggtgttgatcaaaaggatgcctctaataattagaatatcaagctctgtggcttcccagggaacatgattattttagaaagtcagatctcctgcagaggcacagggccagtttttgagaagctgtatacctcagattctcaaacacgcttttcyatgaaaagcccatgaagaagataccataaaaacaatgctcttatattaattttagagaattcactcttaccttgtaccaggttaccgctggactttgtgcatcactttggcagctgagactggggcaagaaatagagccagtgctcccaagaagtaggtcttgcttatgtgatgcggaatactcacaggatgcatttgtctggggcttaacttctaaaatcatcttgacacaacaggctacatcataggggctcctaggaaattaacaagatcctgtgaacatagatattttgtctaga

SEQ ID NO: 159 - DNA, 599 bp, Homo sapiens
tgttatgggagttcacgtacatgtggttcatagctaaaagtcattgtgaaacttgctcttgttccctttttctatttgcactgtactcctttccaccatctcacctgtgcaagacatctgtcactcaggcccaccttggattcgtcctaactgtcctccaagagctgtcttttgggaatgtatttcaggctcctgtaactttcacaaacccttcaagacttatgtgttgagtcctcccttcccctttgcaatgcctgttgctttcctaagacagtgaaaatgagtgaacctatcttcctrcattagcagatgttagtaggtttatgtctaacctcatgtgtaatatacttgaattttagaagtttctctggtgttgatcaaaaggatgcctctaataattagaatatcaagctctgtggcttcccagggaacatgattattttagaaagtcagatctcctgcagaggcacagggccagtttttgagaagctgtatacctcagattctcaaacacgcttttccatgaaaagcccatgaagaagataccataaaaacaatgctcttatattaattttagagaattcactcttaccttgtac

SEQ ID NO: 160 - DNA, 599 bp, Homo sapiens
gcatctttttttaaaatctattgaccattaaatgtattgtatatatttaatctattgtaaatgtatacaattatgatttgttaattaaaaataattttaaaataaagaagttgaaaaaaatttaaacaatctgcaagcctgttcttaattcgccaattaaaaatattgtggaatgctccagagactccaagcccagggatttatttcagttgtatactctgtatatctggtgggtgtatccctggtcagcagttttatttgaattcagtaaagccatgttttcattctctcagccagtgycagcttcacctattcagagatgggtcgtaggtatgacttacccaccacctgagaacctgggggttagcatgaaggaaaaaggcattaggtgttttttcctgcctaatgccatcacttttagtgatgtactactgccataaggtctgtgatttccaggttactatgtgcctttatatgcatgtgtatgtgtgagtgcacacacacatatgtgtaattcacaaaaccaggacctgtccaaatctgtatcagaggtacaattttcataacagccattgttcacctattcttaaggtggctgc

SEQ ID NO: 161 - DNA, 599 bp, Homo sapiens
ctcttttttcttagtctagctaagagtttgttaattttgtttttagttttttcagtaaaccaactcttagttttattcattttttcctattgtttttctaatctctgtttcatttatttctgcttttatctttgttacttcctttcttctgcaaactttgggcttcatttattaccctttttctaacatctttctgtgtatcattagattgcttatttgaaatctttcctgtgtttcaatgcagacattcattgctataaatttccctcaggactgctttcgctgcatcccacatgtttkagtacactgtgttttaacttgtttgtctcaatttattttttaacttcctttttatttcttctttatcccattggttgtttaggagcactttgtttcatttctgcatatgtgcatattttccaagatattttctgtttttagatttctacctttatgcctttgtagcccaaaatacacttgatatgatttcaattttcttaaagttgttaagacttatcttgtagctgaacgtatccttcctggaaaatgttctatgtgtacttgagaaggatgtgtattctgctgctgttggatagaat

SEQ ID NO: 162 - DNA, 599 bp, Homo sapiens
gcagactgtcttcccaaatagcctgcaactttgcctgatcagaggcagtcacagagcaatacccttgtgtcttccattcacccacaacatgaaggaattgcttaattaactaaaagggcacccaaatgccctacatctggccgagaaatactgttgttagaatgtgtagttgggcaggacaacaggctaggccctgaggcaaagttagttatctgggattgctgctcagcaatttgggatgggcagggggagaaactaggctacaaagatgtgtgtgggcttgatcttacccctgggccrgggatagccttaggcagggcattgaggcttgattgggttgccacgcaccttctggacctgggtggggccagctgctccttctgcagataactgctgacctgcctttgcctcctggcctggggaaggctgcaggaaggtgctggagcctggctgggtcaccatgcttggagattattaattaaaatatttaatgactgaaaaagtcagaattaaagtgagttatttattatttatgctactaactttttctatatatttttctaatttctaaaaatgtaatgaaaaaatagccttggcat

SEQ ID NO: 163 - DNA, 599 bp, Homo sapiens
tatatttatttctgttaaataatttgttgtttttagttcattctacatgtcaagaggttggaattctgattttgaatgccaacatattagccatcacacgcaggtttgtgaggcatgtagatgagatcaacatggtatgttctccctcaagcccctgctaaaactacgggcgaggctaacaccagggacagagtgctctgctgttaactccagtttgatccttctagttacatatgatccattcatccacaacgcaagggtgttgcttaattaactaaaagggcactcgaatgccctatrtctgatcattcagctcacaatgtacctttggtttaacagagagatcatgagaatatttttcaagtgactcacaatagtgaagatactctgtgtctgccatactcctgtgaacctccagtctattcagttgtgggcaacaatgagattgccttgatatgattgttgttagcaaatgcaagctggctgatattaaccatcacttccttttctaagggttcataaaccatctgttaaataattaattcaagactttcactagaaattgacatctagcccattatcaataatttccataatat

SEQ ID NO: 164 - DNA, 599 bp, Homo sapiens
ccagtctattcagttgtgggcaacaatgagattgccttgatatgattgttgttagcaaatgcaagctggctgatattaaccatcacttccttttctaagggttcataaaccatctgttaaataattaattcaagactttcactagaaattgacatctagcccattatcaataatttccataatatactccattcccattaaaagataaatattagtaaaaaaaaaatctatcaatagaatgttgttagttgataactggggcaagagactgcaactacacttaacgggaaagagcaacayagacaacagaaacagaaaagcaaagggtatgttcagtgtatggtcacactgagtggctcactgtggtgggagctgagagttcttaagtggtttaattaggactagaatggaaataaaggttgtgtggttctcatgatggttatggggaccttgctgatgtgtttgaactttatgagtgtgagtcctgatccaggacaggacagaaagaagtggaaacagaaagaaggtggcagatgctagtgatattttcatgtaataaaatgaaagattaaaagctttgactgggagtgtgtgtaaaa

SEQ ID NO: 165 - DNA, 599 bp, Homo sapiens
gagcactgagaatcaacctcatttttttctggttctgagttttattttctgattgaggaatttcccttccactttgcctgcctactagtagaagctgggattcccccacgccacatccctcgtgtgtttcctgtggtccaagaaggaatttccagcaggctggaaaggagactaagggtgggggcagagtggccagagaagtgcagctgtgggcaggaagcaaaacaaggcaaagaggtagtggtatacaaggctaaatatataccagatgatctcaagaatcaggaacttttcaaaagkaagttttaaaacatagggggaaattcaaagataaaacttcagaggacgcagtgataacatataaagatcagaattcaggggagaggcgtgtcataaatcgcatgagaacgtaatggtgggaggacacagagccgtaactaagacctcacctaagccaagggggaggatggggaataatgtatcttttttacccataaataggtaagtgaggcttagtatgtatcattaagactttatgaaatggaacttagaggaaatatcaaagaaaagaaattagggagaagcaatttatgccaagg

SEQ ID NO: 166 - DNA, 599 bp, Homo sapiens
ctgtgagttcgtggacagtcagagctgttgttcaagtgagaaccattggtaagtgagatttttatctcaagatttgagatctgagcagcaaattaaaattatcttcttttggcttagtaagtttttcctcttagggaaagaaaaggatagtcatatacttgtaatcatgtaaaacctttcatgtgggcaaacatcaaagttgccatcccccagggaaggctaagttctgaaacagtttcaaattctcacaagttgggttgtccatgaatatgtccctgatttgcttttgtaataaatttwaaaaatgtatgaaacatttcacacacagaaatattgtgacatccaggtacctatcaccagttttaactatgttaccattttcccacatgcttcaaatcataattttttttctttaaagtaacaaaatattgcaaagacaacttgaggtctatgaccccattctcttccaggcctttgctcccacagtatagtaacatcttgtcatttatatcatttccatttatgtttttatgctttttctacatatgtatgcatctattaacaaaatagaatattgttttgagttatgaaatatgttt

SEQ ID NO: 167 - DNA, 599 bp, Homo sapiens
gagtttcacttggtcttggggtgctctgtgtggtttgtatcttgtaataagaaaagattaatatcttaactaacagctacgtcaaccactctgttgctctttgatataaagcatgagtgactggctgtcttatgttttcacttcttagaccacatttaaattaattctatcacatagttgattcaagctgatgcttgcagatctggtaagaacgacccaagggaaaggttaggacaaaaacagacaagttgcggaagaaagccaatgaaccaaaaaacatatagcaaaatgttcaacctyatattagtcagggaagtatactatggagcagaaaagaaacaaataaaaacaaagctccacttaacaccagtcataaagtctgataacaccaagtattatttgggaacaaagggcatttactgctaatggggctgtaaattggcaaaccaataatttaataaaataccaagtgtttatgacacaaacatatttcataactcaaaacaatattctattttgttaatagatgcatacatatgtagaaaaagcataaaaacataaatggaaatgatataaatgacaagatgttactatactgt

SEQ ID NO: 168 - DNA, 599 bp, Homo sapiens
tttcagtcaagccctctctgttgtcatccctgtcttcctcatttaatcattcattctcatatttattcatttccacacaaatatttactgaacatgtaatatgtgtcaggcttggagctaaggctacaagaatgagtgcccggatgctttatctggcctccaagaactttccattttgagaagaagacaaaggtgaagcaggctgtcataatacagtgcagcaagagaaaggagcactatgggcacatggaggcccaccagacccaacctggggaagcccgctccaagtgagagctgatrgatgaggacacaccagctcagtaagggtggggagcttccattccagactgaggaagcagcagagctgatgtccaggagatgaagaagagcatctgggagtaggactgacatcacactcttctaatacgtgttaaaattatctaattacctaattatctaatacgtgttaaaatttatgaaggaacaatggggaggcattgaggattttaagtgggagaatgtcgtgactgaatttgtattcaagatagatcaccttgtttgctgggtcggaagtgggtttgtaagagcaggaatggagg

SEQ ID NO: 169 - DNA, 599 bp, Homo sapiens
tgaagggaaagagcatttgaagaggagattaagtattaggcttaaaaggacttttagtcatccaagtcatgacgacaagtaggtatttggacaagccagtctggagaagttagggctggagatgtgaatgtgaagatgatcgatttttacataatatctgaagccaaagagctgaatgagatcacctaggaagtgggcatagagacagaaggggctagagccaaacccggaaatgcttgaagaggtggagaagaggaagacaatcctcaaagaggatgggaacatacatcagcaagtgartatcagtggaagggtggtgagaagagaaacaaacgaagtgaaattgatgatgtaggaaagacataacctcaggcaccaagacctttcatagggaagaggcctagagagtaaacttactacccaggggtatcaggaggagtgaaagaacactaggagaggactaatagttaaaagagacacagaggaagggacaggcacagagaagtgaatatagcggttgaaagtaagcagtagagtacgggaacatggaaccaaaagaagagagggtttcaaagagagcatggccaacagtgtccaat

SEQ ID NO: 170 - DNA, 599 bp, Homo sapiens
gggcataatcacatttttcgtctactttacctcttagcagcattggacactgttggccatgctctctttgaaaccctctcttcttttggttccatgttcccgtactctactgcttactttcaaccgctatattcacttctctgtgcctgtcccttcctctgtgtctcttttaactattagtcctctcctagtgttctttcactcctcctgatacccctgggtagtaagtttactctctaggcctcttccctatgaaaggtcttggtgcctgaggttatgtctttcctacatcatcaattkcacttcgtttgtttctcttctcaccacccttccactgatattcacttgctgatgtatgttcccatcctctttgaggattgtcttcctcttctccacctcttcaagcatttccgggtttggctctagccccttctgtctctatgcccacttcctaggtgatctcattcagctctttggcttcagatattatgtaaaaatcgatcatcttcacattcacatctccagccctaacttctccagactggcttgtccaaatacctacttgtcgtcatgacttggatgactaaaagtccttttaa

SEQ ID NO: 171 - DNA, 599 bp, Homo sapiens
tggtgaatttggttaagcagttttagtggacagatggcggcggaaatcaggttccataggaggtgaaaggatggagggaattagcacatagaactgcctttcaagaatttggctgggaaggaaggagaataagtgaggctgggatataaggcagggtgtgttttctcttttttaggatgatgagactgagcatgaataaatgttgatgagaagaagcccagagaaagcgagagagagagagggagagagagacaagttaaaaatacaggactgagatggtgcaaaggggagaaggaggtytctgagaagtaaaagtaggtgatgtcaacagcaaagaccctggatttttctttatccagaaaaagacacaccttcaggaggaagtttgacagtggaggcatatttgacagtggaggcatatttgtggcaagaagttgatggataaaattgttaattaaggactggactcttctttattttgaaataaaccatgagtttaaggatggaggggtggactcggatatgcttgacttgcacagtttcttgggtggattctcctttcagttcaattactcagccagatggcaccacaaagaaat

SEQ ID NO: 172 - DNA, 599 bp, Homo sapiens
tgtgccagaaataatgaaacgtctacacagctctcattcagaaatgcataaaaccaggtacattttttctaatgggcaatccttctatctcaaccatatgactatatgttcttaaaatgaagatgagcatgattatatcactaagggtccttatgtggattgagggagacactaagaaaactaagaaaatgaggagtttctgagatcagcccggtcttctgcactactgttgaagtacaaggtgtgtccataaagaaaattttactatccaatatttgtttattaagtaaaaatcataamgttattgtagcacgtggtttaaataaaaaaattatttcgatattaagcaatttttctgaacaattcactatggatgggcatgcatattatgagactaacttttttctacccatttttttccatgaggaatattcacatatgctctgcctcaaatctaatatttaaccatgaaatgactaggagctccatttgaatactcatctttgcaccttaacgtttttccactggtaataccttataattcactaatacatatgtaacttgactatatgaattaatctaattttttcctccttctt

SEQ ID NO: 173 - DNA, 599 bp, Homo sapiens
ttcctgggcttgtgccacgctgctccacccaggaagttgggagtcttggcatttattcacaatttgagttctctgaagttaccaatctacaatccatctttgtgttaagaaatcttgtgtatgtgaatgatgttttaggctgtgttgctctgagaccacgatgccagctcctattcactgagtgcttcctacctgtcacacattgtgataggcataacacctctgctgtaaccacgcctcccagtgagcttgcaaagtgcaggctattatccatagattatcaatgggtgatggaggctyaccggggctaagggtcatgttgacatcagatagaaaatgggtttaaacccaagggtgggtgatgtcaaaacataccctcttgactacactctcctactgtgaactctaatgcaatatcagcttaagatgggccccaatgaccttcctgatcttagaaattcttgctaaattttattgttgtgaccaaaatctgttctgtacttttttgtaatgatgtatacttttcaaaatgatattgcattttcttattgatatctgttaagtatcagaagaaggtacttaatgcatagactcttact

SEQ ID NO: 174 - DNA, 599 bp, Homo sapiens
ggtgagcctccatcacccattgataatctatggataatagcctgcactttgcaagctcactgggaggcgtggttacagcagaggtgttatgcctatcacaatgtgtgacaggtaggaagcactcagtgaataggagctggcatcgtggtctcagagcaacacagcctaaaacatcattcacatacacaagatttcttaacacaaagatggattgtagattggtaacttcagagaactcaaattgtgaataaatgccaagactcccaacttcctgggtggagcagcgtggcacaagcccargaatcaagctgcccattccctgcagtgtggtctggggctactcacccaccttctttgccttgtccttgtcactggccaaggccattatgatcctattatactctagggttcctgggaggtgaggaatggaggacattagagtccatattttgtgcacagaagagggactgatacatagtaaaccttcagtaggagttggtcattttaaatatttttcttaaggtattgttattatctattctcaaggggaattcttaagagtaaggaaggtcagatgagtctcacaaataaataatgtc

SEQ ID NO: 175 - DNA, 599 bp, Homo sapiens
gcatcgtggtctcagagcaacacagcctaaaacatcattcacatacacaagatttcttaacacaaagatggattgtagattggtaacttcagagaactcaaattgtgaataaatgccaagactcccaacttcctgggtggagcagcgtggcacaagcccaggaatcaagctgcccattccctgcagtgtggtctggggctactcacccaccttctttgccttgtccttgtcactggccaaggccattatgatcctattatactctagggttcctgggaggtgaggaatggaggacattaragtccatattttgtgcacagaagagggactgatacatagtaaaccttcagtaggagttggtcattttaaatatttttcttaaggtattgttattatctattctcaaggggaattcttaagagtaaggaaggtcagatgagtctcacaaataaataatgtcttagcgtgaatgcttagaagagtcaataattgaatcaagaatgagccctttttgaccatcttacattctcgtggtatcttatactattgatctcacagttctctaaaagccaaactgttggctgcttatacgtgttcca

SEQ ID NO: 176 - DNA, 599 bp, Homo sapiens
gcccaggaggcatgaaactgctttcacttgagaggggaggagttttcctaaagaatagtaataatgatgacagcgattacattttctaggtgacagacattgttttaagcactttcctggtgtcaacccatttaataccttgaccaaagccacacaactagtaaactgcatattactggtttagagctagttctcttaagtaatagtctgcgtttgggaggccatgttggaaaagcaactcattcatgcactcattcattcacgcattcattctacaatagctatggggtatgcccagartggcaggcattgtgctaagacctagcctcctttccaatttttctttcctggctttcaaatccaaaggacatgatggattcatgttctgatgagtggagaatggaagagagaaggagtaatcttgttcattgttcaaaatggtgtgtgtatatcacggatatattaaaaaaaaaaaagctggagtagaaattctaggtaaggaaaagcgtttaaatttctttgaaaagatgcccagagatgaaattgatatcattcattcctttaattaatagataactatagttataagcaggtttgaa

SEQ ID NO: 177 - DNA, 599 bp, Homo sapiens
atgcccagaatggcaggcattgtgctaagacctagcctcctttccaatttttctttcctggctttcaaatccaaaggacatgatggattcatgttctgatgagtggagaatggaagagagaaggagtaatcttgttcattgttcaaaatggtgtgtgtatatcacggatatattaaaaaaaaaaaagctggagtagaaattctaggtaaggaaaagcgtttaaatttctttgaaaagatgcccagagatgaaattgatatcattcattcctttaattaatagataactatagttataagyaggtttgaatgtttctgaggcttcaacaagacaaagtgtgttctggcctgtagtaaacgctctgtgaagggggttttcccccatgggagtatgcaggagatccctcgtgtcaggtaagccagatgggactcctggtctcaggaaatttaggctgcagtaggaatgataatacaggaaaataatttacaatatgcaatgagagagatgtaaatggattgtgtggacgtttacgaggggaaaaaataaaaggaatatgataagtttcccaggccaccctgatcaggaactgcccattcccc

SEQ ID NO: 178 - DNA, 599 bp, Homo sapiens
atctgatgtatcccattccgaagcctgtgagttaagtgttgggattttctacttcttccagtgagttccttagtctcagtaatcatatgcatttatgaagtatgcatatgaaaatatcctataacaagttatatacatatagttttccatctagaatagaggggaatggacatttatcttgcacctcctatgagccaggcaccaagaagttcatatacattatctcatgaaacccttaaaacagcctgcccaggagttatgattgtctttattttacatatggggattcacatatcagcrtatgggccatcaactctccgagcaagtactttttctccttggatacgatgtgctgggtgttagcagtactttgcttactggatatcatcatgttggatggggcagactcctgcttgatgtgtgactaatgagacagaaacactgcaggtgcaaagaaggctcagagaaactcctgagttcatgtgacttaatcaaagaatgcctcagccatttgacctaaaatcagtaaaaatgcaagactgcttcataaattagaattcgatttggggtgaaaaatcaataccgctcagtggtatgat

SEQ ID NO: 179 - DNA, 599 bp, Homo sapiens
aagaaagaaagaaagaaagaaagagagggagggagggagggagggagattcatgtataaatgaacagaatgtgtggatgttccataagctaaaaactatgaaatacttatgagcaaaattaaagaacaattaaataaagagagaagcatagcatgtttggtgatacaaagattcaacatattgtcaaatcaacaatcccctttacattgattaagaggtttaacgcaattccaactgatattccagcagaattttttgtagattataggcaaactaattctaaaatatatgtgggaaagygaataaactagaaaaaccaaagctatttggaaaagaaaataaagttggaggagtcatgctagacgattttatgaatcaataaaaagttacagcaaccaaaatggtgtgatattaacaaagcaatagatcaatggaactgagtagaaagtctagaaatacatccacacaaatatggcctattgattttgacaaattttcaaaggcaattcaataaagaatagagttttaaacaaatggttttgcatcaattggacatacatatgcaataagatgaagctcacagcttatacaaaattaac

SEQ ID NO: 180 - DNA, 599 bp, Homo sapiens
aagcatagcatgtttggtgatacaaagattcaacatattgtcaaatcaacaatcccctttacattgattaagaggtttaacgcaattccaactgatattccagcagaattttttgtagattataggcaaactaattctaaaatatatgtgggaaagcgaataaactagaaaaaccaaagctatttggaaaagaaaataaagttggaggagtcatgctagacgattttatgaatcaataaaaagttacagcaaccaaaatggtgtgatattaacaaagcaatagatcaatggaactgagtmgaaagtctagaaatacatccacacaaatatggcctattgattttgacaaattttcaaaggcaattcaataaagaatagagttttaaacaaatggttttgcatcaattggacatacatatgcaataagatgaagctcacagcttatacaaaattaacttgtaataggccatagatctcaatgtaaagcctaaatctataaaactgttagaagaaaacatgacctaggattagaaaaagagttcttagatgtaacaccaaaagcatgatccgtagagaaaaaaaaagttggagtttaacaa

SEQ ID NO: 181 - DNA, 599 bp, Homo sapiens
agcagaattttttgtagattataggcaaactaattctaaaatatatgtgggaaagcgaataaactagaaaaaccaaagctatttggaaaagaaaataaagttggaggagtcatgctagacgattttatgaatcaataaaaagttacagcaaccaaaatggtgtgatattaacaaagcaatagatcaatggaactgagtagaaagtctagaaatacatccacacaaatatggcctattgattttgacaaattttcaaaggcaattcaataaagaatagagttttaaacaaatggttttgcrtcaattggacatacatatgcaataagatgaagctcacagcttatacaaaattaacttgtaataggccatagatctcaatgtaaagcctaaatctataaaactgttagaagaaaacatgacctaggattagaaaaagagttcttagatgtaacaccaaaagcatgatccgtagagaaaaaaaaagttggagtttaacaaagttaaaaccactttttccgagaaaaccactgctaaaaggatgaaaaaaaaaaacaagctttaaattgacaaaaattatttcaaaatcacaagtccaataa

SEQ ID NO: 182 - DNA, 599 bp, Homo sapiens
cacacaaatatggcctattgattttgacaaattttcaaaggcaattcaataaagaatagagttttaaacaaatggttttgcatcaattggacatacatatgcaataagatgaagctcacagcttatacaaaattaacttgtaataggccatagatctcaatgtaaagcctaaatctataaaactgttagaagaaaacatgacctaggattagaaaaagagttcttagatgtaacaccaaaagcatgatccgtagagaaaaaaaaagttggagtttaacaaagttaaaaccactttttcckagaaaaccactgctaaaaggatgaaaaaaaaaaacaagctttaaattgacaaaaattatttcaaaatcacaagtccaataaaggacttgtgctgagagtttataaagatttctctaaactcaataataacaagtagctaccaattaaaaaaggagcaaaaacttgaatagacattttgctaaagaggacagacagatggcaaacaggcacataaaaagatgtgcaacagcaccatccactgggaaaatggaaattaaagccacaaggagaaaacacacacacacacacaccatggggca

SEQ ID NO: 183 - DNA, 599 bp, Homo sapiens
catagattctgtggggatgagaactcagctctgtacagctttagcaggggtgaaatgtcagtcttccccgctggcagaaagcctcgcatctatgagttgtgaccttggagctctctaattggggggctgtagggtcttttacataggtctctggggatgcgagtgctggaccagtttggctacccttagcaagtcctgcaggggttttgtctaacatctctgtttgaactgagagtgcacttgccactctaagtccttaaatttgttacctttgccaaaattcaaggtcaactgaaaaaygccccatttaacctctgattgtaccacccccaggtaagtttctgtgccctttaaaaagccaactatatacaggaaagtctctgaccagaacttggcacagttaaatatcacttactggcttttcttacctttgtattctggttcatttcacgtctaggagtttttcataagccccacatctgtaactggataattgaacaggctgaatttactaagatatctgcagaaaatggcgttgctcttctcccaccattgcctcactacattttttaaggtcgcatttgcttcaactgatcaga

SEQ ID NO: 184 - DNA, 599 bp, Homo sapiens
agcttctctaaaacagaagttgcctctagaaaactgagggtaaaaagagaagaatgttccctaagctcctcttctggctatgcacagctgaaaccctgggggatggatgggagattctcttgccatgtgtaccaccctcaattagtcccatgagggaagacaggatatagcaatctaaattataaggcacccactggggagaggatgtctggccattcctttcctgccactgggctctatgtgtgagcgggtttctatgaacagatgacaagaaccacagggattcttgggactggcacsaaaaaggggtcaggaaggcaggtcagagaaggtcaagtttctacaaccaatatagttatctgaataattagatcaaaactgtcaggtatccaatagcttgctgcggacctaaaattccaggatgattcttttaactctctgctttgcaaatgaaaactgtttatattttcccttcaccatcacaagtataaacaggaaagcgcacagcaccctgcgatactctggtgcacctgtgaatggatcttttctgagaaattaagttaactgataattattatttggatcatatttccatttat

SEQ ID NO: 185 - DNA, 599 bp, Homo sapiens
actcatttattatatctaatagttttttagtcaattattcaggatattctgtttaaatattttagagtaatctatttaaaagatcatgcaagtggaaatagtttgactttttttccttccaatctgaatgccttttgtttcttttcattgtctaaatgccctgactaaaagcagctctagtagaatattgaatggaagtggcaagagtgtatctctttgtcttgttcctgttctttcagggaaatgtatttagtcttttccctttaagtatgatgttggctgtgtattatcatgttgaasaagtttccttccattcctgacctgtagagtgtttttaaaataaaaggttgttgattttgtcaaatgcttttctcagtctgttgaaatggtcatgtggttttgccttaattctattgacatgtatgttatatgaaataatttttaaatattaaaccaaccttgccttcctgagataaatcccactttgtataaataagtttgaattgttacatcttcttgatagattgacacttttctttttcttaaatgtccctctttatctctagtaacatttgttattttaaagcatatttcgtcag

SEQ ID NO: 186 - DNA, 599 bp, Homo sapiens
ctgtagacagtatgtagtccataatttttttctgcctaaaaactggatattttagatgatttcttgtagcaattcttgatgctgctttctccccctcccccaactccagggcttgttgttgcttaattgtttgctgtttgtttagtgacttggctggactatatcagcaaagtctatttccctgtgcagctttttatactgatcctcagccagtgaagcctggggcatggttataatacccctaagccctttctcccttcccccagaataacaatggttttagcaggcttctctgacttyctttcactgatatattaagcttctagctggtctgttgtatctattgacatcacactcaactgttagcctccagtaactgctggctgaaatggcctattgttttcaacaatgccttgggttataaattactccacagtccgatccaattaaagtcaggctcctttgcagggtaatctttgagaccagtctctgagacatgttatagcctcaggagagctcttttcagccatctctttttctggttcttctgttaaacttctagttggtctactctttaacttattgcaatcatggagcta

SEQ ID NO: 187 - DNA, 599 bp, Homo sapiens
catattgagtcgattattttttctcaaagaatatatgaatatcctttaatagaaagctgctttataataggtgttttatttttatttgcattttattgtacttttctttctaaaaagaaatgagggagcaagtctcacatagtgccttgtggaaagaccaaaatgaagaatcaaaagacttatgtactcagacattagttatctgattggctttggaaaattacctgtttgagccttatagtttgagcctttatagttttctcatctataaaataaagatgctgtccatacctggtaacmctttcctgctctaaaattccaaattttgtgagtatatggcaacccgtttagccttatgatcacctgatggctgatagtccagtccctctcagagtaaaaatgccaatcttgggaggatggtaagagaacaacttgagctctgcaacagtctactaacttgtggtccaggttaagatgtagcagcccacttcatcaaccatcggcatcacttccactcatgcagtactttcttacagatgtcagaacattctttctaaaatgatttcttagtataaggtccccagaaagtgtatgtgaga

SEQ ID NO: 188 - DNA, 599 bp, Homo sapiens
tcttgcagtttgatgtaaaagagatgttggggtagtatatggatgatgtattattctcattttttactgagtatcagtaatcattgcaaaagtgttgtatcttatcctaaaagtataagaaatgtaatttaaaataaaaactaacatttaagtgccaactacatgccaaattctttacttgctttatctcatttaatgttcctagctactcaatgaggcagatattttcctctctgtttcagataaggaatttctgaaaggtaattaacttcaccaaggtcacctggcaacaagtagaasagcgagaagtaggctcataaaaattatctcaaaattctttcatcaacattctatgatgctgcttctttttaacaacaacaaatgttttttaaatggaaaatctggatgtgccatggagttttacaaatccaggtatttaggtgtatttatggaacttgttctttggcttcctgttttttaaaaattatagtgtaaagttcatagagatctgaacttcattccttctatgaatgactgctcatggagtctggtaacatgcaaaagtttcagtgtttgctaccatccttgttgttaccacc

SEQ ID NO: 189 - DNA, 599 bp, Homo sapiens
ccttcttatcctccttcttcctcatgtatagagaccatataagacagtttgctggacaattctggtttgtgcctatagctttgcataattatcattattattcattccccaaagtgtcctggtttagataatttcatggtcaccttaacgttcataactgaaagtgtcaagggtgttgtattgcaggtgcccactaggtgtcagcagtgtgacctccagagaaccctcagagaaaggatttcattacaaaagtcaaatcaaagcaaataattaagtgtagttccagagctacctgaagcygtggtcattcaaaacaaatgagaggacagggggaggagagaaggaacaagcgcagatcaggtagctccttcttgggatctgatagacagggaaggtttcctttcctcattagaaggactccagtgatctgtggaatgagcactacagtatccttttaaattttcacccacaagacaaagccagtatgcagtgaaatgaggaaatgcctttaagtgaagagatttttatttctttcataaattgctcaagccatgattggatggaggtcctccaggtagctccatggactttaacaagtc

SEQ ID NO: 190 - DNA, 599 bp, Homo sapiens
tccttttaaattttcacccacaagacaaagccagtatgcagtgaaatgaggaaatgcctttaagtgaagagatttttatttctttcataaattgctcaagccatgattggatggaggtcctccaggtagctccatggactttaacaagtctattgaataactgcatttgagttggaagctgagttgcctgaacacaaacgatttaaaccagattagaaagtgtctacatacagagctcaataacacactcggaatcttcttgggaggacccacagactgtacctatattacttttgaccyaggtggatgcagtcactctctagaagcctccccgacttcagatgtgtggcacacatccacacaggggtgtaggtaggagaagcccacaggaatggctctgcagatgttcgtgacttacagtccttggaattgtttgctactgctagtggctcttgagtgttctgaagcatcttctgatttgaatgaatctgcaaattccactgctcagtatgcatctaacgcttggtttgctgctgccagctcagagccagaggaagggatatctgtttttgaactggattatgactatgtgcaaattc

SEQ ID NO: 191 - DNA, 599 bp, Homo sapiens
taattatctcaaatgctaagcacaatgcctcctttgcctcagctataaactttatgctatttgagtatgtagattgccttattgagatagaatcaatgaaacattttaattctcatttatttatatgtgtatgttttctctaggatgggtgtgtaatgtgggttgagccttgaggtctggcagttaccttctgtgtgctctggctattcacttagctccctccctgtgggtgtggggacactggtataggtgtcccctttagactctcctttatagttgctattcattttgagctagtaragtgtgaatattaaataggaatgttagtttgaagaagtcttgtgcaatttgcttagtgaataagttacacaaaggatcttactatatttttaagaggtatacaagtaaaaatggctttccaaatggataacattctcagttcagaacagtctaacatcttttgtgaaatcatatagacactgattgtgttcaaggtgatcttacttggtacttgagttttccttttaaaacaatatgctagagattctgtgttccctgctccccattccacaacctggcttcctcttcacagaaatggc

SEQ ID NO: 192 - DNA, 599 bp, Homo sapiens
cagaagcgtgcatcggctgactgtacattttctcttacggaacactggaatggtgaggagaaatgatactgaaaaattgcggcttcttcttttctatctgattgaaagtcttggtgttcagggttgggaaggatacattgttcgtgttaacacgcctggtctgcttacttaggaaaatggcagcattctttgtgtgttcgctcgtgaagtttctggatgagtatggaagatgctgactctggctcgaggagctttaaagggaaataagaatacatgcacgcctgtgtgcaacagccctgrccctagtttctctgtatcctgttgcccaggtttgctttcttctgagctgtctatcactctctgacatctgattatttatgtgtgagttggctgttcactcgctgtccatccctcctcaagagaggttccaaggacatgggtgtctttttacaaatgtcacttacaacgtatatagttaaaaccaagtaacactgttttatattttcaatcatttcacaatgtaatttgtaatctgctttgaacctcagaagagtctgtatcttattttgttttgttttgtgttacaactgacattcatt

SEQ ID NO: 193 - DNA, 599 bp, Homo sapiens
ctttctgcccaccctgatcctctctctctttgcccgcagcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcarcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcgga

SEQ ID NO: 194 - DNA, 599 bp, Homo sapiens
gcaggcaagcctgagaggccggtctccaggctttgcagctcccggcaagaggtcccagaggtcttgcccttccagagatgaatgcttgaggcccagaacatggggccatccggagccaaggcctgggatgttagaggaggggaactcgggactccatgcaaggaccacgggtcagccctgtgcctgtccagaccacctgcatgggacacagcaggggcccagaactgggcatccagtggatcactgcagcagcatctgtgtgtccatatccaggtagccgcacccagattttccctccarggaccaccccctcccactctcagttcaaggtggtccatgtggagcacccacctctggcccagccagtcagagccatcctggctgattgattctgggcacatgactctggaggatccatggagagtccaacctggaaacttggcaagaatcctcggggactgccctcctgctggggtcatgtggcactgggagctgcggtggccatctttactgccacccaggagagcctgccggagagtgagaccaacacagagcagcagagacagagacagactggctcccgagcgttcagccccagt

SEQ ID NO: 195 - DNA, 599 bp, Homo sapiens
ctatataatccacagacctgtgacatggccttacaccagccagatactcaggaaatgtttacaggggaatgttaggcatgacctatcagggcactgcatttctctcaaggcacagcgattggttcagagatggccaaacccaagtcactcaagccaattaaagtgagtcccaggacttttgcttggacagctggaaaagatattaattttcccacttacctctttaacagtggggagtatgaagccagaactgctgcagttagtttgccacaccagaggagaggcttcctgagaatggartcatgcagagcaagcagaccccagagacagatagaaagcaaacaaggttttcacagcatcatttaagcccccggatcaaaccatacctaaagaccacccttagattttttttctgttacatgcagcaacacctcctttctccccaacctttttttttattttaaagagagtttggatccctactgctgcaatgaataacagaagggcatttggtaaatgattcaaccctagacatgtgtttgaaatcactcctgccggataggtgagcaaaactgctgacggctagtcccggttttgct

SEQ ID NO: 196 - DNA, 599 bp, Homo sapiens
cagatagaaagcaaacaaggttttcacagcatcatttaagcccccggatcaaaccatacctaaagaccacccttagattttttttctgttacatgcagcaacacctcctttctccccaacctttttttttattttaaagagagtttggatccctactgctgcaatgaataacagaagggcatttggtaaatgattcaaccctagacatgtgtttgaaatcactcctgccggataggtgagcaaaactgctgacggctagtcccggttttgctccgcctagacatggtgtggtaaaggcamacctttgctatgggagttataaggcaatcagaaggtttcctctttccaaaaatgtcctagacatcttccaaagtagagtaattcacaagtgtttataccaaaggcaaactctccatccaatgttctatctcctgagtggggatgtcctcgccagaaagcctcagttagacgctggtctttcacacttgtctgtaatggccaaccactctctccttcagcccgacagtgcctttcttggtttaagccagtgcaaacaatgctccaacacgggcagccggatgggagaggctggacgggaa

SEQ ID NO: 197 - DNA, 599 bp, Homo sapiens
ccttttggagtccccagtgtctgttctcattttcatgtccatgtgtacccaagatttagcttccacctgtaagtgagaacatgaggtatttggctttctatttctgcattaattcatttatgataatagcttccagctgcagccatgttgctgcaaaggacatgattttgttcttttttatggcttcatagtgttccatggtgtacatgtgccacattttctttatccaatccactgctgatggattgactttcaagttgattttatgactttcctattgtgaataggacaagttaaatyctaatttatgcacaacttatatactgaacatggttatacagtttgcttgcagacgttgaataagtaaccaggggaagcatagggtggaatggaactaaatgtgcttagggacttataattccagggagttcagaaaaactttcctgaggaactaatgtttaagctgaaacctaaaagataatgaagcctgtttcttctgtcctttttcttgtgttttcaatcacaccccatcttctcatttgcctggtgatttttaattgcgtgccagacattgtctatgaaaacctatagagataata

SEQ ID NO: 198 - DNA, 599 bp, Homo sapiens
ccagtgtctgttctcattttcatgtccatgtgtacccaagatttagcttccacctgtaagtgagaacatgaggtatttggctttctatttctgcattaattcatttatgataatagcttccagctgcagccatgttgctgcaaaggacatgattttgttcttttttatggcttcatagtgttccatggtgtacatgtgccacattttctttatccaatccactgctgatggattgactttcaagttgattttatgactttcctattgtgaataggacaagttaaatcctaatttatgcamaacttatatactgaacatggttatacagtttgcttgcagacgttgaataagtaaccaggggaagcatagggtggaatggaactaaatgtgcttagggacttataattccagggagttcagaaaaactttcctgaggaactaatgtttaagctgaaacctaaaagataatgaagcctgtttcttctgtcctttttcttgtgttttcaatcacaccccatcttctcatttgcctggtgatttttaattgcgtgccagacattgtctatgaaaacctatagagataatataaagttctgaat

SEQ ID NO: 199 - DNA, 599 bp, Homo sapiens
aaattcagtggtgcttaatatattcatggatttatgcaagcatttctaaatcaattttagaatgttttcatagctcaaaaaaaaaattcacatcctttaactatcacccctcttatcacccccatatgccctacctctaagcaaccactaatctactttctgtccctataatttgcctattctagacattcaataaaaatgggattatattctttttgtgactagctctttttgtggtctttctgtgactagctctttcacttagcataatgttttcaagttttatccaagtagtaacawgcgccagtattcctttctctttatgactgaataatattctagtctatggctatatcacattttatttacccatttatcagttgatggacatttgggttgtttctaccttttggatattatgaatagtgcttctgtgaacatttgtgtacaagttttaatgtaaacatgtgtttccacttctcttgggtagatacccaagagtaaaatttctaagtcatagggtaactccacgcttgaccatttgaagaactgccagactgttttctaaagtgactgtaccattttatattcccaccagc

SEQ ID NO: 200 - DNA, 599 bp, Homo sapiens
tcggctcactgcaacctccacctcctgggttggagcaattttcctgcctcagcctcccaagtagctggaactacaggtgtgcgccaccatacccagctaatttttgtatttttagtagagacggagtttcaccgggttggccaggatggtctcgatctcttgacctcgtgattcacctgcctcggcctcccaaagtgctgggattacatgtgtaagccaccacacccggcctgtagagagttttaaaatcaggacgtgtaagtcctcctactttgttcttctttttaagaattgtttttrgctattcttgatcccccacaattccatatgaatcttagaaccagattttctattttaccattaaaagaattcagctgtgattctgacagagactttgttgaatctgtacatcaatttggggaatattgtcattttaacaatattaagacttctgatccatgcatatgggatgttcttccatttatttctatttcctttttttttttttttttttttttttttttttttttttttgagatgtagcttcgctcttgttgcccaggctggagtgcaatggctcaatctcggctgactgcaac

SEQ ID NO: 201 - DNA, 599 bp, Homo sapiens
gtataatgttaaatagaagtggcaagagtgggtatccttgccttgtgtctgatcctagagaaaaagtatccagtctttcatgattcagtatgatgttagcagtaggtgttttgtagatgtcctttatcaggttgaggaagttcccttctactacaggtttgatgaatgtttttattatgaaatgttgttggattttgtcaaatgcttttttctgcatctattgagatgatcatttggttttgtccttcattctgttgatatggtgtattgcactgattgatttttaaatgttgactaacyttacattcttgaataaataccccttggttatagtgtataatttgttatatatgttgctggattgagtctgccagtattttgtgtaggagttttgcattcataatcatgagatattggtctgtagttttcttctcgtgtaatttttttgtctggttttggtatcagtgtactgctggcatcatagaaagagttgggaattgttctctcatcttctttttttttggagaaaaagttgtgaaattctttaaatttttggtagaattcaccagaagtcatctggccctgagtttctctttggg

SEQ ID NO: 202 - DNA, 599 bp, Homo sapiens
gaattagttttggtagtttgtgcctttctaggaatttgcccacttcatctaggttacctaattttattagcatataattgatcacagttttcatttataatcatttttatttctgtaagttcagtagtaacattccctcattcattcctgattctaaatattgagtcttttctgtcttttacttattcagtccagctaaaagtctattttacatgaattagtatagccaatccagccctcttgtgtttgctgtttgcataatatatccttttccaattctttttttcagtctatttgtayctgtaactccaaattgtggctcctttagacaaggtatagttgggtcttgtttgtttttcccgtgtgacaatctctgacttttgactagattgtttaatccatttacatataatgttattattgatataatcggatctacttctgctattttacttttttttctctgtctactgtcttttttgttcctctattcctactttactccttccctttgcattaaatattttctaatttagcctttaaatttatgtaatgttattttcaatatattcttttgaggtatttccttagtggttgat

SEQ ID NO: 203 - DNA, 599 bp, Homo sapiens
gcttacctttcccagtgtggatccttcatcccacaggacagggggtgagcagtaggggccccaggattctcggtggttctgtgccctgtactgagcctttgtcctacaagtggggggtgctgggcagaaggaagcctccacttctgagatgcacttgcccggaatttagcctcagcaacaggtagctgtgggcagaatgagaaaaatctgaagatctgcccctcccaggaggataacccttcaacagaaagctgcagggtggcgggggaaggagtcctgtgtcctcgactatactagcaygatgcagggtttcactatctcactgagctgggagcaaggggaaagagggtcttggtccaaataccacagactgagttttaggagatttgcttgaataaatatttcttcatttgccatatgttcttaggaccatttccagagtgattgttttagaataactttttaccagttttgattgcagctgggtccatagagctcctcatgctgtcaggccagaagtacaaacttgcttccagggtgtagtgccctttggggtctgaacctggggattttatcaaggcccctgcttctgggcagtt

SEQ ID NO: 204 - DNA, 599 bp, Homo sapiens
aatgaacacattccctctcctaacaccttctcatagcactcaaggactttaccatccgagtcccccacctttgcagcttcatgttggcttctatatttgtccactttcctgactacaaagttctttcatgtactttgtcccatgaaattctcccaagatccctctcgcttaggattttttttaatccccattttacaggtggggaaatcaaggcaaggcaaagttaagactcaaccaagatgccccaactagtaagtggcagagcctctgctcgcttcacctaggcctgttaacaccacrtcttgagttctagtcacgactctaagctgcctttctcatgaacctatgcccctaatataggctttatttttgcccgccacactgtgcctatcctcaaacattgccgagaaaagccctttcctcatctccactttcacaaatctcctctatcctgaattcagtgtaggctcaaacatcacttcaaaaataagacagtaccagatgttcttggcctcagtgattggatcgttggtgatcacaagacacacactagaccaattagagtaaattctggaacttttgctggaatcactggaaaa

SEQ ID NO: 205 - DNA, 599 bp, Homo sapiens
ccttccacctgcccattaactcctgaaagttcctccatgaggagatccacaaggacctgctagtgatgggtgcgtacgagatctccaacaagtctgggggtgctggcagcctgcacagccacctcaaggtcacagattctgctggccacattctctactccaaagaggatgcaaccaaagggaaatttgcctttatcctggaagattatgacatgtttgaagtgtgatttgagagcaaggaaacagggtggatacctgatcaattcgtaatcctagacatgaagcatggagtagaggcaraaaagaaattacaaggagattacaaaagtcgagaagcttaaaccgttatagatggagctgcaatgcctagaagacctgtcagaatctattgttaatgattttgctacgtgaagaagagagagatgtgtagtactaatgaatcaacaaacacttgagccctgtacttcagtgtctctttaatgttctgcttcattggactagccacctggcaggttttctacctgtgttgcttcttcaaggccaagatgtcgattgagtaatgaacgaagtgcactctcctcccaccttgtatctcaggc

SEQ ID NO: 206 - DNA, 599 bp, Homo sapiens
tcctgctcggaccttaccctcaaggaatgcagaaccccctgtgtatccctttctcctcctgatatagtttagatatttatccccaccaaatcttcatgttgaattgtaatcccagtgttgcagatggggcctggtgggaggagttttggtcatgggggtggacccctcatggcttggtgctgtcctcactgtagtaagttctcacaagatctaattgtttaggtgtgtgccacctaccccctcccactctctctctcttttgctcctgcttttgctatatgaggtacctgatcctgcttyaccgtccaccatgactgtaagcttcttgaggcctccccagaagccaagcagatgccagcaccatgcttgtacagcctgcagaaccatgaaccaattaaacctcttttctttataaattacccagtctcaggtatttctttataacaatgcaagaaaagctgaatatacctccccactggagcactagccccagacctgtcacaagtcagatgtcacatatgcttatagagacaagaaagaggacatggaagtcccagaggggctgcaggtagtatcctggcaagggttgagctctggaa

SEQ ID NO: 207 - DNA, 599 bp, Homo sapiens
gacttcactggggctgggctccaggggcagaaggaaagggaagagcaagcaagccccaatgcacaaggtctttgaaagccttgccctgcatcacctttcctactgttccatttttccaaagcaggtcacacgtccaaacccagagacaaggtgtggagcaatagactccacctgggaagagctgcagagtgcggtggatgagaggagaagtattcatggccattgttacaatttattcagggagctcatttcaatggggacatctcccactatcatcgctggcctgcaaagaatagtcawggcacagcctttcaagatgcccatgcttccctcaccaatgtgttacccaaagctttggtccagaaaacatcgtctgaactcctcaccccagggatcatggttaggtggtagatgagtatttgactgctcaaatctcaataacttccagagccctagctgtgagggagtccagaaaaggtactttgtatccttccagcctctgcagtacaggaaggaccccaaaaggtggtgacatggatgctgagcaccagtccaacatgtccgcccacgctgaggagcttcatgaggagggaggtgag

SEQ ID NO: 208 - DNA, 599 bp, Homo sapiens
acacgagtggatcacctgaggtctggagttcaagaccagcctggccaacatggcaaaaccccgtctctactaaaaatacaaaaaaaaaaaaaaattagcagggcgtggtgacaggcacctgtaatcccagctacttaggaggctgaggcaggagaatcgcttgaaccaggaggcagaggtttcagtgagtagagatcgagccactgcactccagattgggtgacaagagtgagactcgatctcaaaaaaaaaaaaaaaggaagtgaatgaagagcaaaaggagaccactgtgggcaactragaacacagtccaggcagagcgaacagagggcaaagcccttggtgtggtaaggaaatcactgtgtccagggagcagacacagctacatgccccggtgtggccgtgtggcttgaagctgagtaagcaagagaggaagggaggaacaggctcacagaggagctggagaggtcacagaagctccctgatgaccagagcctctgttcagccagaacactccagtggaacaccttgtgtccactaacgaggccttgccactaatttggcaaagaagtaaataatgtgttaaaactcagatgtcc

SEQ ID NO: 209 - DNA, 599 bp, Homo sapiens
atttaaacaaacaggaatttatttttctcacgtgagaaatctaaggtgctgttcaatggctgaggcatgcccggctgaaactgctgtcagtctctttcctcatggtcacaagatggctgccttagctcctgccattagatccatgttcaaagcaaggagaaagaggaaaggggaagggttgcaccagctgagtccctctctttctgtcaggaaagaaaggctttttaaaagctatgcccagaagatatctgctaatatatcatgggtcaaaaatgagccacatgccacccctagctatartgaagtctgggaagtatttggctgtcagcctctatagtgaaaggcaccaagggagcagagggctggggacagatgctgggacaacctacgcagcagctatctggcattgatgctgtgggtcacccaaggccccaccccatctggctccaccgtgcaatgagccaccagccacccgcacacagctgtgctcagtgctagaaccaatgagagctcagcccgcaataccaggagcgttcttcaaactccaggcaggcctctaaaattatctccaggcttctggtgagggttacagggcaact

SEQ ID NO: 210 - DNA, 599 bp, Homo sapiens
caagaaacctgaccaaggcagactcacccgcgcaggcgctgagtcatgttgacagcaggtgcccttgctaggatgtgatgggcagggcgcttacctctgcgggcatcctcccccaacaaacaatcccggtctaaccaggagaaaaacacctgttttttccgacagagggacatgctatagaatgcctgactgtactgccccgaactgtcaaggccatccaaaacatggaaagtctgagaaactgtcacagccaagagaagagcctaaggggaagactaaatgcgatggggagccctgcaygggatcctggggccactgggtaaaatggggaagcctgaatgaggcatggacttcagttacactgcatcggcctcggctggctcaaccgcaccacagtaagagaagacattaacaccaggggaaactaggtgtggcgtctatgggaactctctgtaccatcgctgcaacttttctgtaaatctaaaagtgctctaaaataagaagtttatctaaacataagtgaaaggcagctgaaaactctgaatgcagcacacagaaacaggtccagcacagcaaggagacggaaactatggaaaaga

SEQ ID NO: 211 - DNA, 599 bp, Homo sapiens
cacggtgaaatcccgtctctactaaaaatacaaaaaattagccaggcgtggtggcgggcgcctgtagtcccagctactcgggaggctgaggcaggagaatggtgtgaacctgggaggcggagcttgcagtgagccaagatcgcgccactgcactccagcctgggcgacagagcgagactccgtctcaaaaaaaaaaaaaaaagaaaatataaattctccaaatggagaagcaaaaatcccgaacctgataaataaaactaaagcaacacctggatacgtcgcagcgaaactgcagaccaycacacacagagagaactgtggcagacgctgtggcacccagagccccccaggacagagacctggtccccagtggcagcagggctggcggcctggctctcggctatgtccctctccaggaactgctgccagctgaatacagctgcctctccccacttccccgtgggtgcagctggcatggaatgactggtccaagtggggacccaaaagcccagctccggagttcccacggggtccaccgagggctatgccgatgctgctacctttgctccctcagaggcactgtccccaagaacacaccc

SEQ ID NO: 212 - DNA, 599 bp, Homo sapiens
tatattaataataatttttaaagtaccaagtagcatagggtttataataaaaagcattggccccaatccctctccctgggagcagacagccttaattagttcatctccatacatttaaatactaagcctaaaactaccattatttcatgtatcaacttaaatcatgctctgttgactgcctaccaggacagccaagctggacagtcagttaaaacctagctgccgccacctgcacctcccccagttttatttaatgtgtttagttcctccattgcagagttatcaaccctcagtcattcytgtgccacttttgcaatttttgctttatctctctagtgcctacctgcattaccatttacttactacttatttttttaattgatttgctttgttaaatgaaagtactttaaaagaaagcatttacttcactatcattctttaaatcttatgctaagacacatttaaactagtatcactgcccactgatatcccacctgaaacccttgtaagcacccttcccacactttcaactttaaatcatatacttaaaccttactgcctccgtgtattttgacatctctgggggagacagctgcttc

SEQ ID NO: 213 - DNA, 599 bp, Homo sapiens
agcatagggtttataataaaaagcattggccccaatccctctccctgggagcagacagccttaattagttcatctccatacatttaaatactaagcctaaaactaccattatttcatgtatcaacttaaatcatgctctgttgactgcctaccaggacagccaagctggacagtcagttaaaacctagctgccgccacctgcacctcccccagttttatttaatgtgtttagttcctccattgcagagttatcaaccctcagtcattcttgtgccacttttgcaatttttgctttatctstctagtgcctacctgcattaccatttacttactacttatttttttaattgatttgctttgttaaatgaaagtactttaaaagaaagcatttacttcactatcattctttaaatcttatgctaagacacatttaaactagtatcactgcccactgatatcccacctgaaacccttgtaagcacccttcccacactttcaactttaaatcatatacttaaaccttactgcctccgtgtattttgacatctctgggggagacagctgcttctctccccaaccttcccaacctgctcctccct

SEQ ID NO: 214 - DNA, 599 bp, Homo sapiens
atctccatacatttaaatactaagcctaaaactaccattatttcatgtatcaacttaaatcatgctctgttgactgcctaccaggacagccaagctggacagtcagttaaaacctagctgccgccacctgcacctcccccagttttatttaatgtgtttagttcctccattgcagagttatcaaccctcagtcattcttgtgccacttttgcaatttttgctttatctctctagtgcctacctgcattaccatttacttactacttatttttttaattgatttgctttgttaaatgaaartactttaaaagaaagcatttacttcactatcattctttaaatcttatgctaagacacatttaaactagtatcactgcccactgatatcccacctgaaacccttgtaagcacccttcccacactttcaactttaaatcatatacttaaaccttactgcctccgtgtattttgacatctctgggggagacagctgcttctctccccaaccttcccaacctgctcctccctcagatctcctaccttggttgacagcaattccatccttcccatcattcaggccaaagcctcagagtcaccct

SEQ ID NO: 215 - DNA, 599 bp, Homo sapiens
agttggaggactgagtcccagggccctccaaattccagcagcccagagatgagaaaggaccagctttaaaggtggattcagagataccagcaaaggagaggagatacagcgtgtgctgataaacctgccctctgaaaataaagaaataaacgcattgatttgtagagttttccagtttccatggtgtaaataactcccactgtggtccatttcaggctaccaacatgacgtcactgaacagggagtcaggagctttgcacatagtcaactcttgcaaactattatgagtttgtcctgctycccactgcctggaaaccaagcaaacagagagttacaaaaaaagaattacaagcatgaagggtgaacaaccatgttaaatgccgttgacatgtcaaattagctgaggacttccgcagtgatggatgtaacactttgccacgcaaaaatgttaaacgtagatcaggcaggatgcaaaaatagcataacttcacactctgtaaagttacactccccagtacaactttcaaaccggagcaataaagagagaaacaattccctggatcatttatttttaatctctcctcaattctaacatatgc

SEQ ID NO: 216 - DNA, 599 bp, Homo sapiens
ggtgtaaataactcccactgtggtccatttcaggctaccaacatgacgtcactgaacagggagtcaggagctttgcacatagtcaactcttgcaaactattatgagtttgtcctgctccccactgcctggaaaccaagcaaacagagagttacaaaaaaagaattacaagcatgaagggtgaacaaccatgttaaatgccgttgacatgtcaaattagctgaggacttccgcagtgatggatgtaacactttgccacgcaaaaatgttaaacgtagatcaggcaggatgcaaaaatagcrtaacttcacactctgtaaagttacactccccagtacaactttcaaaccggagcaataaagagagaaacaattccctggatcatttatttttaatctctcctcaattctaacatatgcattcaggccataattgtccctctaagcatggctttaactgcattccaacgtttgtacatgtaatattttaattatcgtttgttcaaaacataattttaattgccatcacgctttttctcaggcctgagagttttttaagactgctgttcggccgggcatggtggctcacacctgtaatccca

SEQ ID NO: 217 - DNA, 599 bp, Homo sapiens
ctcaaggaaaaagtgaccccaaatgctgagctcacctttccccatgtttcctttgcgtggatcttcatcccaccgtcagctctccagtgccttccggcaggccttcgactggactgttttgtgcagctcctctgggcgtcctcagtggaagggctgctacaaaccacctagtgcctttgcaaaaatcaaaagtctcacctcatttttcaaaggaaaaagacaagcttttcactccacggaaggagtctcccctttccattcctaaagagatctctaccatgatgttatatcaggaatgtratgagaatctgagggaaaaggtctgcgactatggactcctaaaggcaggcagtattaagaacagagttggcaactcgcagcagccaaaatgctaatacagaattctgtttccaccaaaaaaaaaaaaaaaaaaaaggccagacatggtgattcacgcctgtaattccaacatattagggggctgaggccggaggatcacttgagctcaggaattcgagaccaacctggtcaatatagtgagacctcatctctataaaaaaattaaaaattaattgaatatagtggtacacacctgtagt

SEQ ID NO: 218 - DNA, 599 bp, Homo sapiens
ccgttaaatcttccgagcacataggcaagatagaaacaccactgccacttggtgacagtgtgctttaattgcagggaatgggaaacaaaggcccaaaagcaagtcacagattagaacagcatcaccacaggaggtctgagagccaagcctctgcctcaaaatctgacagggaaggaacaatctagaagacagattctgaagacattctggaaaagagagactgagtacagtacaacccctggtcctttcttccttctgccctaggccccagctcagcccatctgctcaccttccctatcyctagttctcacggtagggaacagcttatttacaaagggaactctaaggtctcaggaggaattttggtcaatattttagccacttcctacattcagcctcgctcaaggtctctcttcttgattgtattgtcctaatctactttcccaccaacataaatagtatttctagctcttgtcctaactgagagaaagtttgtgttggaattgctactgggaaatctctagtgactcttcatgttaaaagaggaggaaggggctgggcatggtggctcacacctgtcatcttagcactttgggagg

SEQ ID NO: 219 - DNA, 599 bp, Homo sapiens
aaaaagtgagactccatctcaaacaaaacaaaacaaaacaaaacaaaacaaaacaataaaatttaccaccataaccattttaaagtatagagttcattggcatgagatacaatcatattgctgtgcaacactcaccactgttcatctccagaatgtttttcattgtcccaaactgaaattctgcacccattaaacactaactccccattctccctcctccagcccccggcaaccaccttctacttctctgtgtctgtgaatgtgactgctggggatcttatatgaatagaatcatgcagracttgactttgtgtgcctggcttatttcactcagcatcatgtcctccaggttcaccgatgtggcagcagagctcagaacctccttcctttttaaggctgtgtaatagtccattgtgggacaggctgcattcatttatccattcatctgtagatggacacttgagtttctcccaccttttggctattgtgactttggcttattttaacattatataaaatgaggccaggcatggtagctcctacctgtaatcccagcactttgggaggctgaggtgggaggattgcttgagcctaggagg

SEQ ID NO: 220 - DNA, 599 bp, Homo sapiens
cagggcatactgactgtgatagacacgtcctcatcctcacaggccgacagtccagtgggaagatcaggctttagtgaaaccactgcaaatatctcattgcaaaacaaaatagctgccttagaaagttgtgatcaggtggtttttccgactttttttttttttttagcagcagaacccttcattcaaatgaagccttacccaggactgggtcatggaaaatagctgaaagcaaagttgctcagaggctctgtggctgtcaccagagagcccgacggcttcaaggaacacagctggaaaccrgagcttgatgtctgggagggaggggtgaggaaaggcccacagtggcacagcagagtcctggcacattgtgggcactggagaagccatccctgcctgagctcgtcatctctctctctctctctcaccatgtcaaatggtagtgggtgggtacagggcccaaactcggtccccagacccccgagtgtctctggtgccagagaccccacaatgcctagaagcttccaaccaccctggcccagggtgcctaggggctgagagtctgggggtccctggaggcgggagacgctgagtctaggcag

SEQ ID NO: 221 - DNA, 599 bp, Homo sapiens
cgtggtaggggcttcaagaatacgcatcaaatgaacccgaacccaaggacgcttgctcacctgtgtcatctgggggtctccttccacaggaagcacatctgggcagagtgaaggctcccagggctcaggtccagaaagagctggaggctcctgagagcaaggggccctactcggccatgagcccagaacaatgcgagcttcacacaccgcaggtgtgtgcgtgtgggagcctcttcctgaagccttggggtcaggggccggggcccagcaggctgggtttattgtccattgtctcaggcygggacaggaagcactttctgttcccaattgctcgggtggattaatttacagtggggagctcagagtcgcccacggcacctgttttcccctctgaggggccagcttccagcttggagggtgtttcaggaggggtctcctctgcagagacgtggcctcctccagagacccttggccacagcccctgcccgctccgtgctgggccgaggccaaggccctggcagccctgcctgcttgcccgggtcacgctgcccacccacggggaaagctgagccctgtggagtgcacaccatgctgtcagc

SEQ ID NO: 222 - DNA, 599 bp, Homo sapiens
cctgcttgcagggtcttaggtctattgtcccattactcctgacaaggtagttgctatgagtccccccactccaaagatggaaaagctgaggcacacagagggtaagtcatctgccaaaggtcattgagccaggaggttggccagggagatctctgctcaccgagttgggactgaggagtggcaagggggagagtagtgtttagggagacccactgcgtgcctgccaccaggctaagtgccctctgcactaagctactctcatcctcgagcaatattaagaggctggcatcgtgcacccarttttagagatgaagaagcagggcctccgggaccagaagcctcagctcacacaggattgagtgcagagctaaggctagagcctgtctgcctggctgcagggcctaacccctggagagagaagacaacatcaccctgctggtgctgtcctctcagccccctccatgccctgggcactggggccggatgcccagcagggggtggtggccttggccctgggcagacattctagaaagccagcagttcattaggtcccctgctccaaaacacaagggccatgcttgagactcatgggtgagggc

SEQ ID NO: 223 - DNA, 599 bp, Homo sapiens
cagtagtagcagttcaaagtcacaacaaaattttgaaccaaagacaaaagcaattatctttaagagatcaccttttcctttttgagatggagtctcactctatcactcaggctggagtgcaatggtgcgatctcggctcaccacaacctccacctcttgggttcaagcgattctcctgcctcaacctcccgaatagctgggattacctattagaatgtttttaacttttgttccattgttgaacatttacactgttttacactcttgctatttataaacagccctgagagaaacagctasatatctgtcttagaagacttaaattatttttttctttttttgagacagagtgttgctctgtcgcccaggctggagtgcagtggcatgatctcagctcactgcaacttccacctcccaggttcaagagattctattgcctcagcctcccgagtagctgggactactggcacctgccaccatgtcctgttaataaaagacttaaattactatattaaaggtgatctcttggctgggtgcagtggctcatgcctgtaatcccagcactttgggaggccaagtcaggtgaatttcctgaggtc

SEQ ID NO: 224 - DNA, 599 bp, Homo sapiens
agatgtcatggcaccactgcactccagcttgggtgacagagcaagaccctgtctaaaaaaaaaaaaaatgcttctatgtcttttgtttttagcactaaataacattacattggattttccacaggaacttatccattcacctactgaaagacatcttggttgcttccaagttttggcaattatgaataaatgaatacacatccatgtgcaggtttttgtgtgacacaaattttcaactcctttgggtgaataccaaggagtacaattgtatgaattgtatggtaagggtatgtttagttyagtatgaaactgccaaactgtcttccaaagtggctgtgccattttacattcccatcaacaatgaatgagagttaatgttgctccacatcctcgtcagcacttgggccattctaataggtgtccagtggtatctcattgttttaatttgcattcccctgatgatagatgataggaaggatctttcttctgcttgatttgctgtctgtagaccttctttgctaaggtgtctattaaggtctttagcccactttttttttttttttttttttgagacaaggtctcgctctgtcacccaggct

SEQ ID NO: 225 - DNA, 599 bp, Homo sapiens
tgaccccttaatttacaagatactaagggctccttacccaacccccttccgcaaggagttaacctgtgtaagcagatcctcagcatttcaaagtagcccaattaactgataaggtactagcaccaacaatgtatgaagttcccaggatttttctcaaagagataacaacataaagccttgagttcctgtccggcataccccctatatctaattataataaaggtttaaagccttgcacctggtaccgttgctcttcttgtaaccatttgtcttttaaattgtttatctctttgtaaccawtttttttttattcttgcatgtttttacttctgtagaattattgcatttgagttcccctccccttcctaaacctaggtataaaagttaatcaacccccttcctcggggccaagagaattttgagcgttagccgtctctttggccgccggcttaataaaggactcttaaatcgtctcaaagtgtggcgttctctctaacacccctgggcacaacaagaggttgtggtgagcgaaggtcacgccactgcactccagcctgggcaacagagtgagaccctgtctcaaaaataaataaacaaat

SEQ ID NO: 226 - DNA, 599 bp, Homo sapiens
cactgccaacagcagatatgcgggggttatttccccacacaccaaacatcgattctgcggattccccagtagacatcagctgggtgtcctccagttcagttctgacaccatctacctggagatagtgtcagatcccacaggttgagggctctagtcccacaaggctgccccccacttcagatgctgcaagcacgggtcgtggtctgtgcttctgaccaattggctataaactggggctcccaggatttatttaattggctagtgtggctcacaagactcagggaaccacttactgatgtrtactggtttcttataaaggatattacaaagaatacagatgaacactgtaatcccagcactttgggaggctgagcgaggcaggcagatcacctgaggtcaggagttggagatcagcctggccaacatggcaaaaccccgtctctactaaaaacataaaaattagctgggcatggtggcatgtgcctgtagtcccagctactcaggaggctgaggcatgagaatcgcttgaacctgggaggtaggggttgtggtgaggcaaaattgtgccactgcactgcagcctgggcaacagagtgaga

SEQ ID NO: 227 - DNA, 599 bp, Homo sapiens
gttcagttaaggcaattatttccctcatcatgtcagatagatatgaatgttatggactgaatgtttatgttccaccaaaattcaaatgttgaagccctaatctcttatgtgaacgtatttggaggtggggactttgggaagtaattaggtcctaagagtgaagccttcatgatgaaattaagaagagacaccagagagatgatctctctctccatcatgtgaggataaagcaaaactaaggccatctgcaagccaggaagagagccttcaccaggactaagtggagtctgccttgacctkggacttccagcattcagaactgtaagaaataaatatctgttgtttaagacaccccatttatggtattttgctatagcagcctgagcagaataagtcacctagcctcactctgcaacggaaaaataatgactcatgaagattgtcactccaaaccctttgcaaaggaagatacaaatgcccaaggctgctcattacataattgctcagaaacactgtttctcaggtgtacacgatgctgcacacgtccactgagacacctagtggtaggcagttctgtctatctgaagataaaaagcaaa

SEQ ID NO: 228 - DNA, 599 bp, Homo sapiens
actatattgttttaattattaattctcatggctcttttaaaatcatttatttataaaacaaaatattataggacattatctgaatcttcagatttattccactgcaactagtagttgttcaataaatattaaatataattgacttacattaagatataatgagtgtaggcaatgtgctaggtcctaaacacagatacaaatgcagatataaacatcataataggaattcaaatgcacggattggaaattatcaagatcattacaaaacgattgttctctataagaaatcctttcaagaasagtaaccaacaaaaaagctctaactacaaaaatacaaaattacatggaaaaggtaatgcaattcattgtatcagagaagtttgggggtttgggggaaagcaggcattcttcgttgaattaaacaacaatggagctataaattagcacatccttttaataggaataacacccacactacagttttataaatctcttctttccaaccagtgagagtagcctatactctctgaggtaagaagtcattgagtttctttccaggttttgtaaaatcgcaaagtaggaaatatttattaaatatc

SEQ ID NO: 229 - DNA, 599 bp, Homo sapiens
gcaagatgaaaagtttaacaaacaggaactgtggccctctataaaggaaagcatccaatctacagtgagccaacagctggagagtgggtgaattaaaatccgaacttcactgtcttactactttctgatctcttgccaatatctcacattaggtgaactcaaccagaagctggaggtcagcggagcctgtggatgcagtccttatgggtctgcttccaaggcataaagccacatagggaaggacagagattagacctaaaggggaaattagaagatatccggcatagtaaatatccttgmaaagtatccagaactgaaactatcctttagctctgacttcttccaaaactttttttgaagcattctaagaaagctcaactcctatattcttcttgaacaaccttctccctattcatgtcctgttatgttgtagaaaaacagtaaagtaagcaagaacttgttttacccccaccggctgggagtaagactgtttcttcacagagcaatgaacgtaagcatgaggtttacatgaatatatttagtctcctcactctccaattcaaaaagatctgggaacatttcacagccatgggctgatt

SEQ ID NO: 230 - DNA, 599 bp, Homo sapiens
ttcttcacagagcaatgaacgtaagcatgaggtttacatgaatatatttagtctcctcactctccaattcaaaaagatctgggaacatttcacagccatgggctgattatgcaggtatcatcagcctgggaatataatgaaataaaaaagttgtttttcacatttgtcataggaaactccttcacctactttctggtccacaaatgttcccaagagatcttagaggaactatggagtctggtgaaccacatcaatgattcagaccaacagcaaatctgcatgagcataaacataaaatgsaaaggaaacaggcaaaataaatatcactttcagaggtgaacactagccacttctccttacataaataccatgcttggctataaacaaggtagaatatgaaaaaaagaaacaatgtccacctctgaaagtgtgacactctcttttatatgagcatatgaaaaccaagaagtagaatgattttatgacttgtgtcctggagggtccagagcaatacactttactttcaagaccaaagaacacccttctgctagggaaactccattattacaccctttctaaattattaccaagcttaagct

SEQ ID NO: 231 - DNA, 599 bp, Homo sapiens
aaggagggaaagaataagagaataaaagaaggagtgggaaacaataacgaaatgaaagaaacagtgagaagcattattaaaacaagaaataaaagtattaagaaaattaatgaatgatttatctttttagtgagggtaggagaaaagagctatgtcatggatcattttctggtccttcacatgggtaagagtattgcctaagcttcctgagtaatcacagagtgttacaaatgatgtcacttctatttccatatggaagacacaccattcttgacctaacctaggatttcccaaactacrtatgcagatactgttcactccttcagcatttggacaaatgaaaagagaaggaaaacaggaagcttttcagctcaccctgaattttcacagatggccctggtctgaattgttgccccaggtgagacataagcagattccaggaagacagcagcaaagagctagaaaaagaagtatttatagagaggttctttcaatggaaaagaatttgcttcctgacaatgatcttcatagaaggttaatatgcttaagcacattgagaattcattgaatatctattacatgtagtacagaagacagcc

SEQ ID NO: 232 - DNA, 599 bp, Homo sapiens
tttgtcaaggattcttacaagtgatattcaaatatctaatctaaaatgattatctagaaattggcacattctaagtgtgcagatgctgatgaggagcaggtattgatagacagcgcgttatgcgtcaaaggatgtctatcctttgctaaagtgttactctgactatgctgtaaaaagcaggaggtaagagcttaagaaagaggagtaaaagagataattctcatgagataaactctaaggattgatgctgtgctccaggtctctccagtgttttagatgtttcaggatgctatttattamagaatatggtgtacttggaattttttttaacatacagtagtaatcattttcctgattaacctaatttctagacagagtttgcattcatgaatggccacagtacagatgcggacatccaaaggatggcattattactcacaagcatagtgctatgtgcagttatggcttgagggaagggaggggggaggtcgccctctgagacctgaaccttttggtgtggtttcaagcactaaccagcactatctaatggctatttcactgccttgtcaatgacataggaaaaaggtacctgagtggaa

SEQ ID NO: 233 - DNA, 599 bp, Homo sapiens
tgtcaatgacataggaaaaaggtacctgagtggaaactgttttcagggcacctttaaagcctgggagcaaagggtggagggatgattttccttgtggacttaaaagtctttaccctctttgtcctatttttctttcttccagaccaaaagtaccgagttcaacaacaccgtctcttgtagcaatcgggtgagtagagagttcagtgctgctggctttctccagggagacgccaggcattttggagagggagtatcctgctacgtgcagaactccgagaggtgcctgggctccgggacgcsgccgccgggggaaaggggacatctgggctgtcagagcggggctgcgcctagcttgggacaacacttctgttccaatttagggagaggaagtctctatccggaggaaaggcaaattgggaactgggacgagggaacgttgttaggggcaccacctgctggggtccggcgcctccgcgctcgggctcggaattttggcagcctccgccccctggagacttgggaggagcgagcgtgggtgacagtcttttcgcgacgagtgccctccgccaccctcgccacgcccctgctcccccgcggtt

SEQ ID NO: 234 - DNA, 599 bp, Homo sapiens
attctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttgtttcttatgaatcatctctcaaatctagttagacaatttgcacacatacttttctaagggacattatcttccttcaggtttttacctccactcrtccttagagcccactgactgctcccctttatacctgttggccctgcctataggagagaatatttggagataggcagcttcaggatgcattgcaatcatccttttcttaaattatgtcactagtcttttattttttcccctcttgaactttcctcacacctggaagaaacaaagtaggaaaaagtgaacaggggatgtcaaatcgattcttgaattcccgctgcaagctagagccgcaggcaccctctcactcaatttccactcagaaccctataaacaccagtgggaagggcaacccac

SEQ ID NO: 235 - DNA, 599 bp, Homo sapiens
cccactgactgctcccctttatacctgttggccctgcctataggagagaatatttggagataggcagcttcaggatgcattgcaatcatccttttcttaaattatgtcactagtcttttattttttcccctcttgaactttcctcacacctggaagaaacaaagtaggaaaaagtgaacaggggatgtcaaatcgattcttgaattcccgctgcaagctagagccgcaggcaccctctcactcaatttccactcagaaccctataaacaccagtgggaagggcaacccactgcacgtggraatgcactgatttttcctaggagtagacatgttcctctaattactccctgagggttagttggggctaaaccatgacagaagtggggaagttcaatgtccttaaatccatcttacttgccaacaggtaagaggaagcttacattacatgtccagtccacatttaaagagcacttactgtggaacaagccttcagccaaacaatggggatagaaaagtaggtaagactcagcctttgtccagagaagctcagggtatagctgaataggcagtttcttttgtcctgaggaaaatcaggacat

SEQ ID NO: 236 - DNA, 599 bp, Homo sapiens
cattagaaatcttaaaagtaagacttgaaagaatcaaactgtttccaagtaacttagctgaatcctacaataaacttcaagaatatctgtagaaataaaaaatacctaggacccaaaaaggaaaattcacaatattttgtatacaactaaagattatcagacatgaaaaaagtgagaaaatataacacatgataagggggaaaagtgaaactgattcagagctaacatcgaagttagaattagcagacaaggacattaaaatggttattgtaaaatggttattgtaactatattcaataygttcaaaaagttaaatatagacacagaatacataaagaaaatcccagtccaacttctagatatgaaatctgtaatgtgtgaaatgaaatgcacagtgaatggtaatcatgagagattagatgttgcaaaaaataagatgagtaaacttgaagacataccaagggaaactatccaaaataaaacacagaaggaaaacaataacttaaaaatgaaaagaccatcagagagctgtgaaacaactgcaagtgcctaatatacatgtaataagtctctttaagtaaagaggtacggaaaaaaat

SEQ ID NO: 237 - DNA, 599 bp, Homo sapiens
actagtatagttacgttagtcactcgacccaaaccttaataggctgccaaaacgttttcataaacgaaatgaaatggaaataaaacagtaagagaagaggttattccatatgttgaactttggtcctgggctctaagctcaccactgttttagttaatgttcacatgctcagagattgttccccaaacctacatcttggtaaggcagctggctcctgaggagtgaggcgtcttgacacccacttcactggaatcagtctccttcagcatcctaaggcactcagctctaatgaactgcccrgactcccgtttgcattatgataagctcctctttagaacctctactgtctgcttttgacagccgacctcaaggaatactgacttaatccaggaatcccaataacatttaatatttatcttccttttctgggaggaatctacacttatccaagttgcccaagtgagcagttccctccccacaagtaattagttctactccccagagggtctgtgagtgaatccctctgtcagttttgaaatgtcccattatagttttcatctgtaaatatgtcaatatgtatccaaaagatgaggatcttt

SEQ ID NO: 238 - DNA, 599 bp, Homo sapiens
ttaatatttcgccatccggtcacgtccacgtgctgatttggcacttgcagtcctcctggggcgtgtttcagaggcagcctggccaaggggaaactgctagagaacatctcagttgtatggcagtaatatttgttcagtgaatatttattgaccttcccttgaaggtggaaacataattaagacaaacctctacctcttgcattcttaatgagagagaaaaacatgcacgctattacgttattggtgacacgagctgagttagaaattcactctaggtagaatacattgggagaaccggaratggtgagattaattaccgttagggaaaatatctaatagcaatcagttattttcaactaacgcaaagtgtctggcactgtcactctaagccttgcagccgtttctttgcaacataggtgtcattataccgtagcacctttatataatctattaaagtaaatttcagataaatcacttgttagtgatgattttttctcctataacagttcatcgatcattgtaatagtgtctcttgtttacttgtttcttttgtcttctccgaaagaatgtaacctctgtgagaacagaaaccttgatga

SEQ ID NO: 239 - DNA, 599 bp, Homo sapiens
agactgtacactgctcagattaaccaatgcattgggctgtgacctctaaaactgaaaatacttgggagtaaaaagaaaaaaaaaaggagctaatgaacctaagtcactaattgggtctacaagtgctctatcccatgactatggctatatatgctgtccccagtcagacttcctacagtcctacagattagtttcttctacaggggaaactagacaagttgtgaataggtggtggtagtgatggtagtagctatcatgtattgagcagttactatatgactggccccattctgttttacrcaaatttactcattgaatcctcataacaatcccataaagtaaataaatacctgttttacagatgaagaatttgaggcacagggagcttatttttccagggtcatacagctggatcagtagccatgattggggtcagcaaattacagtctgtaagccagtctagcccactgtttgtttttgtatgacccaggagttacgaatgattttgacatgtttaaatgtttgtgggggcaggctgggggtagggagaaggatatttcatgacatgaaaactatgtgaaaatcaaatttcagtatct

SEQ ID NO: 240 - DNA, 599 bp, Homo sapiens
ctggtagatttagaccagaaaagatctttccttagcagtggagaaaacatagaatctagctttctctaaacagcgaacaggcatctgatttttagaaaaagagttataagctaagttatacataataaataaccaatccacataaagtggtggtgcaaatatgaattttctaggaaagtattttaaaactacacttaataatacacattatgtcctatctcaacaaatatacaaaatagaaaactcctgagatgggaactaacggcataaaaaattttgaagaaggtctccaagtaattytgatattcatctctggcaaagaaactgaagtaaagcaccagttttaagtaagccttttctgaaaatttatcttcctccagaaaactgaatatacattagaaaaaaaagaatactgtatagttccagagtgtgctgggtaaagaatgacaaaattaaagttccctccactatcatgacaaacaaatactgactgacaaacaagtagtttagcgataccaacctctttattacgggcaaatgcagagaaaacatttccataagcagcaaagactaatctgccatcagctgccatacagcag

SEQ ID NO: 241 - DNA, 599 bp, Homo sapiens
atatcaaaattacttggagaccttcttcaaaattttttatgccgttagttcccatctcaggagttttctattttgtatatttgttgagataggacataatgtgtattattaagtgtagttttaaaatactttcctagaaaattcatatttgcaccaccactttatgtggattggttatttattatgtataacttagcttataactctttttctaaaaatcagatgcctgttcgctgtttagagaaagctagattctatgttttctccactgctaaggaaagatcttttctggtctaaatmtaccagttggtttctgaatttgtcctggaacaactagcttgagaagtgacctggccttaatggtctagaatgaaaggaaatgtaggaatgggggtacaaagatagccaaatgatagtatcactgtacttgtcagggacttggagtgaggtggttcccacagtctttcatcatcacttcctgtggcagaggaaggtaacttatctgtagagttctttaatggaaggtgttcagatttttagaattggaaaaaatgttcatttttgtattgttgtttatagttttcccagggagatatatg

SEQ ID NO: 242 - DNA, 599 bp, Homo sapiens
tctctgtcaaagcagaagggtatggggaagaagaccctatatccccctttcccatctcatctgaaagccagttggtgatggagtctttagagatcagccttctggaatataccatctcgctaggatatatgtagttgcactgattgaattgggtgagggaactaggtgtgtgtgcatgcctcctctctaacccaagatggaaggcagagcctcagaggtctcatttctttgttcttaatggacagtttacttccttattgttgaactggctgagggagcagatgaacatgcctggtcccktaatatttatgtgttcatcctaaccttgaataatcaaaagttggggtacatttcttaacagaagcatctcaggattagcatgtttttgggataatatgaataatatgacatgatgactgagtaataatatgaaattcttttaaacttcgatgttttagatagtacatacctttaagggtcataaggcagaaatccatttcttgcaaccctttggagaccacattatctctgttgatactgatggcattcttattatttggcacatatattcagaaggtaagagttaactcatttatttg

SEQ ID NO: 243 - DNA, 599 bp, Homo sapiens
aaaataatctctaataaaggagaaaaaaaaaacgtataaccctgtggagtggggggtggcatcaccagtggtcacttgctccaagataaaaaaattctctgaaatctttggttacattcaaaatttctatgtttgaattctgcttttcactttacagttcctccatgattaaaacaatgttccactctattttccagtaaatttgtgtatcaaagaaggtacatttcacttaatctttaggttcacatactatctggcacactactgtacaatcccagggtatgggtaccacagtttagratgtacaggtataggtgaaaattatataaactttactttgaatgctattttaagagatccttgcctttattcgtcagtcactacaaatggctccctgaatatactggttcaagagagtctgctggaatgtaagaaccagatcctgtaacctaataaaagcccttttaacttctatctgcacagggaatacttttggaattctgttccctccctctacttgagcaaaaacaaaacaagaaaagggttactaatctgaaacaagaacctggaataattcccagaaatgcaatcttcaggat

SEQ ID NO: 244 - DNA, 599 bp, Homo sapiens
attagtatctaagtctgtggtttattttaacatataaatctttgatgtgatagacttactttaagtgataaatatatggttacataaaacattttaaactattttataaaaaatatttataactttcacttttgtagaagaatacctgcagttgacttttgataaatcagtatttaaaatttctgcaattttgcatccaagtacctacttgaataaaatacttctgggcagtgaacaaggaagcctgcagttgtggaatgtaaaatccaagtaagtattttagttagaaaataatatagytgtcaccttatcctcatctactacttcctaatgtatacttaagtctcatttctccctgcccttgtatatttatttggagggttgtctataaataacagttggtcccctgtatcagaggagtcaattaacctgggatcaaaaatattcaaggaaaaataaataaataataatacaacaataaaacatcacattttaaagtagtacagtataacagctatttacatagtatttacattatattaggtcttataagtaagctagagattatttaaagtatatgcataaatgtgtgaaagtta

SEQ ID NO: 245 - DNA, 599 bp, Homo sapiens
catttccaggatggaaagttggagtgacagctcttcagcaggttagtatttttctgttaagtcaaagaggaacaaagttaataggaaaatccttcagtttcaggaatcaatcataattttagacgtaaagacgaaacaatatatagcttagtttacctttaaaattgttagcctgaggaaatagtgttttggaaatgtaagttaaaacaagtaataatgcctttgccaataacacttattggagtcctttgtgcttatagtttgacttaaatctgtggttgctatggatccttgtttctratcattttgcaagtatatgtagtccattgtcttgtgtagactggaaatgagtgttcagcaatgcaagcggtattgtaagtcatgtagagaaatttgtcaagatgttgagatttatggtttgaagtaattggagccaaaatcctaatgtttgattcgatgatggactatttaagaaataactgcttttttttaatgaatctgcaaaatatgtataaataaatgaatgcatgtctacagcgaatcttgtgtttatattggccacatatgtagccactatacccttatctttttcagtatcc

SEQ ID NO: 246 - DNA, 599 bp, Homo sapiens
taaccatagaatattagaactggaacagactaattgtaaaactttttttgccttttcacatgttttgtaggtttttcctactttcttggataagcaattcttcacttcctttgtaattggttacatgttgccacacatagcgcaagcctttatgttttctagttgtctcctttttctgtttccatccagtccagtgatctgtagtgattttatacatagctttctttttctgttgtggttgttttctttccaaaatcttaccagctaggttttgggaatgaggatgggatgttgactggsagaattgaagctgggaagtaatttggaaaaatcattactgaatacttctatgctgaataaaaaagtatgcttgaatggtaatacttgctgagtttttctgccatcttttagaagatacttcattatttcttttgataacacctaataatgatgcgtatcatcaggattattaaagctattttgcttaagaaagtaaaagtttgaataatttaatttttaggcaccagccgtggatgttgttgctattggtcttatgtcaggtcaagttatcattcacaacattaaatttaatgaaacat

SEQ ID NO: 247 - DNA, 599 bp, Homo sapiens
tcaatgcattttattttttcttggatgaactagataaacatgtatggaagaggtagtaagattcctagcatcaaagttgctatagaagtgattgaggttctgctataaggttattgaaaaaagttagacatcttgggtggtaaaaacatactgctgccacccaaaagatgttcatggcctcacttgagctatctgtagagtgcacagtttttaaaatggaaggtagcttagagaaagcatcaaagtaagtggcatccaatatttttgctttaaagcaatcatttattctctttccctttycatggtttccagcctttgaaagattttgtttattaaacaacaaaatcttacttggttttatgattactaatttttaagttactatcttatactgttcatgcatgtatataaattttaagattatttttaacaatatctaaaataacttttcttagaattaaaaaataacagtggtaataacatctttgttttgtttctgacttaaatgggaatatcttgtactttatagttacaagactgatagcttttcttttatatacactttttattaagaaggattcatagctatgtatgttccc

SEQ ID NO: 248 - DNA, 599 bp, Homo sapiens
aggttctgctataaggttattgaaaaaagttagacatcttgggtggtaaaaacatactgctgccacccaaaagatgttcatggcctcacttgagctatctgtagagtgcacagtttttaaaatggaaggtagcttagagaaagcatcaaagtaagtggcatccaatatttttgctttaaagcaatcatttattctctttcccttttcatggtttccagcctttgaaagattttgtttattaaacaacaaaatcttacttggttttatgattactaatttttaagttactatcttatactrttcatgcatgtatataaattttaagattatttttaacaatatctaaaataacttttcttagaattaaaaaataacagtggtaataacatctttgttttgtttctgacttaaatgggaatatcttgtactttatagttacaagactgatagcttttcttttatatacactttttattaagaaggattcatagctatgtatgttcccctttcccccatccttaggattaataaataaaaagagagttaaacgtaaaggacttcagaataccatgtcagtgagacttccacccatcacaaag

SEQ ID NO: 249 - DNA, 599 bp, Homo sapiens
agcaggtaagtaacttcaaactgtgttttgagaagttctcctttgtcatttatttcctactgtatgctgttttattttctgttttaataaatgcttttacaaatattaataagcattcagaaggtaaccccaggtgcatgctggtcttgtgtgaagactaaaaatgagttattttaaatgtgaacttcttatctattaacatcaggctttgctcttctgtataacaggtattaataatatttgattttatagcctttttattctgtcatatgcctggtataatgaaagtcactaatgtaraaagaactggaacagcagagtatgagaacatagagctctgactaattaagatctaagaatactgaggtcttagtatactatgtcatttgacctgtgccactttcaaagaagtgattttaagaaaaatatagataatgggtttgttgcgtgaaatctatcatgggaaattactgtagaggcaccatttctatttgaaagttgttattatgaccacctttctgttttctcagagcttgagtcatgtttctaaaaacatttgaatcacatcacacatctgcttaaaattttttagtggcttc

SEQ ID NO: 250 - DNA, 599 bp, Homo sapiens
ttacgttttagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagtaagtgagcttgtttataagagtatcttctctttaaaactttcctatggaaatcttgttatactcaaggtttctcatcataatattgactgaaaaaacgtagtttaacattttaaagcattgcataacccaaagccacaaaratttgctcctgtgacttctaagagttttctagttttagctcttatatttagatttattctctctgaattgacttttgtgtatggtatgataaaggggtccaaattcatttttttacatgtggatatccagttgtcccagcactatttgttcaaaagactattctttctccattgaaagatcttgtttcctctgctgaaagtcatttgaccatgtatgtaagagtttatttctggactctgaattctcttccattgatctgtatgtctgttcttataccagtaccacactgtcttgattt

SEQ ID NO: 251 - DNA, 599 bp, Homo sapiens
tctgacagtctcagctatctggagcaaagctagtaaccaataagtaataagcaaaaatacgtatagagagcctgtgcactaaagtacaatttgttactcaaagataacattcacggtttatttatttttgctttgtttggcttagataatacattagaatgaataaattagaagaagagaatgccaggagcaggccgactaaaaacaataactcccctaaaaaaatgtaaagcaggacaatgtagggcctgtattacttgcaggttatagcatacaagctcctttagtttcttgattgtrtaactatacaacatagcataaacatttatgaatttttcaaaataggtcagcttaatgtttgtgtttcatttaggaagataaaatgctttttaaccatagtaatttcccatctaaaatactttttttaaaagaaatctttatctagaaaaatgtatgtatgtaaaacatatttatgtgatgcaatgtaaatatgtcgtgacaaagtggtatgtcaaactttatgttgctttgcttagttaaataaaccttcattaaatactttctacttagtttgtataagtcatctgtttagatgtaaa

SEQ ID NO: 252 - DNA, 599 bp, Homo sapiens
taatagaaaaatgaaatctctcttaggttttctcatcctgcaaaattgagatacagaagcgagatgcctaaaccttaagaaagctcatttgacctttttgatactccaaaataaagctcagacttaaggatggcaaacttttgagtttttttagttcatgctgaatttagttaaaaggtcaaaccccctaacttttcctttttgtatgtctcttctgcttctctgacataattcttaaaagaaggcattttagatagtcttagtgcattttctgttgcttataacagaatattgaaactyggttatttctaaagaaaaggagtttatttcttacactttgggggattgagaagccccaggtcaaagggccatatctggtgagagccttcttgctggtggagactctgaagagtcccaaggtggtatggagaatcacagagtaaggggactgagcgtgataatgtaatagcttgagtctgtctttctcttcttataaagccaccagtttccctttcatgataatcccttaatccatgaatgggttaatccattaatgaggacagagtcctcatgatccaatcacctcttaaaggcactcc

SEQ ID NO: 253 - DNA, 599 bp, Homo sapiens
tgaaatctctcttaggttttctcatcctgcaaaattgagatacagaagcgagatgcctaaaccttaagaaagctcatttgacctttttgatactccaaaataaagctcagacttaaggatggcaaacttttgagtttttttagttcatgctgaatttagttaaaaggtcaaaccccctaacttttcctttttgtatgtctcttctgcttctctgacataattcttaaaagaaggcattttagatagtcttagtgcattttctgttgcttataacagaatattgaaacttggttatttctraagaaaaggagtttatttcttacactttgggggattgagaagccccaggtcaaagggccatatctggtgagagccttcttgctggtggagactctgaagagtcccaaggtggtatggagaatcacagagtaaggggactgagcgtgataatgtaatagcttgagtctgtctttctcttcttataaagccaccagtttccctttcatgataatcccttaatccatgaatgggttaatccattaatgaggacagagtcctcatgatccaatcacctcttaaaggcactccctctcaatacc

SEQ ID NO: 254 - DNA, 599 bp, Homo sapiens
ggtttgtctctttcacttaaaatagagtgaagcaaaatcgaatttattgactgtatcctcctcaggcttcagaaagttcacttaaagttggtatttcttcaattaaaaaaacattttgttaaagacactattagaaatattagtggtctgtcacttcttgggctgttgctattttctaaaagttaatgttatataatttgaattgctttaaaataagaaagttgtataaatagtagagttggcatagtgcctttttcattttcctgtttaatagttttagtttatattagtgagagagakagattattcagtagtagtaaattggcaatgtattataagtggtaaattcgtctttggaatgaaaaaattaggatctgaaagtagcattcaaagccactaacctttgactcagcattagccttttgctgaatttcttatatcagtaagaagttgaacagattcaaatctgatagattttcagctctagtatctttatttttaggtgaacaggcaattttaagtgaatagagaggcatgaagctgggtgtagcacaagagcaagaagtgaccacatcgaattgttaaaagaaaatgtaata

SEQ ID NO: 255 - DNA, 599 bp, Homo sapiens
agtttgctcaagcagtaagctttttaacagatagtacctaaacatgttaggaagttttacccttcacgtatgtaaacttttgatgagtaatattaagacaaaggaaataccttaagatttgaaattgccgtgttttaggtttaatctttatatgtgttaggataatatcttcatctctggattgtttggattaaatgacttaacataaataatttaatagtgtatggcatagaataagtatttagcaaatgttttcttttccccaattctcttgattcccaataaaagccattcttgtgrgctttcaaaacagacttgaacagaaatcagacaggttattgctcccttccccataatggacaattaaacagcagtccttttcctgaacacactttgatgtgtgtgtgtttgtttccagtgcttctaattgttgtcttttctttccatcttgcattcattgtttaaggtttacatttttattggctcttttagcaaattgagagaggcgttttaccatgggcaagcaacttaatgcctcccactggacagtcttcatttacatttgagctgctcacagtgtgtgtcccatgaatcactga

SEQ ID NO: 256 - DNA, 599 bp, Homo sapiens
atgaagtactgctattaataacttgaaacctgagattctcaatttttattttctattccagattcataaggtgtgggaaaaagaacctgtcccctaaaagaccggtatctacatcttgattagtcatccatggctagggtgcaggctgagtagcagaaatatggctacttagagggccattctagagaaggggaatctatgacctttcagcagccacaagaatatgctcagcatattcgcactctgacttactctctgagttcatctttccttttaatttccttaaataaaggttgatayatgtcaaaacaatatatgaaatttactttaccttataaaattattatctactactggtctgtctttaatatgtttttgtactacatcaggaaagagactcaataatgtatttacacagctttgttatgatggcatctatgacataagtcaaggcgtttttaaattgataacaatctatctttgaggtattttttaactaataaaagtctgtagtcaaattcaagattgtagagtgtttctctgaaagaaactttttataatttttaaaatattgcttatgttttgatttttcaggtcca

SEQ ID NO: 257 - DNA, 599 bp, Homo sapiens
ttaatatgtttttgtactacatcaggaaagagactcaataatgtatttacacagctttgttatgatggcatctatgacataagtcaaggcgtttttaaattgataacaatctatctttgaggtattttttaactaataaaagtctgtagtcaaattcaagattgtagagtgtttctctgaaagaaactttttataatttttaaaatattgcttatgttttgatttttcaggtccaatatttccctgtattcagttgtttcattacggccacttcctgcagattatgtcccttcaatagtsatgcttcctggtacttgtcaaacccaaggtaattagaaaattgcaaagtaatttttgaggtgtaatattataaacctaatgtaggagatattgctaccaaaggcaaagtttagtgcattcaatcaaagtgttttttaactgatataaaagactttgaatgacttcatgaatttatgcaaaaatataattgatgtggtattgataagctatcaaatagtataccattgaagaaggtgttttgggtctagtgatgggagttttagttaatatgagaaaataaggaaaagacagggataagt

SEQ ID NO: 258 - DNA, 599 bp, Homo sapiens
agtatatcggtgtatgtttgtatgtgttttctgcacttctttaccaagacctagttttacagatatagggtaaattaatgatagcttttaattacaaactatacatttttgggtgatacttgaattatttgaataatgtgtatttgtttttgtttaagtctaaagtggtaaatcttggagttttggctcaaaaatcagatttctgcttgaaacttgaagaaggactggtaaataataagtgtaagttgaattataagatattttaactaatatatttagcttattttactgtatatgagsagaaattgaaggaaatatcagcgttctcagtagttaagatagtaaaaatcaaaaagattgaaattttggttttaatttgacgtaattttagcatttatattaaataagcccactaaactcaaatggtattgatattataaaaatctgttgaagatttttcatatatctaacttactttttgctattggagatggacacagttattgactatatttataataaggagatccttcttgttgtgaattaaatgtaaaagttttgtttgtcgtttttgtagcaagtaatttgcaagtcttttg

SEQ ID NO: 259 - DNA, 599 bp, Homo sapiens
tgacttgttatgtttatggggagacaaagaaataaaaacactattgtttactatatactgaaggatctaaaagtgattagacttttgtcattggtgatactctttttcagaaagctaaagcatagtcattgcagttctcaaatgactcataaaaatagctgtaagtgtactgagtgtgttttcctagggtgcatatgaaacaattcttctagggaaaagaagtaggtttgggctgggtaagaataagggatggggtcttccccctctgattttatatattctgtactgttagtaatatakttcctaatgattatgtacttttataactttataacaatagaaaagaaaaattattttacctcatcagattcccaatgctaaccactattaatacttttgtatgtatcgttataggcttcttaattaggatttactctgagagaagatatatgagcattttaaaattctaacgtgcctgttgcaaggcattagattttctttattaacaggaaaaaggtttaaattacagaaaaaaaatgtgttttgagtactttctcttatattggtgtcatcgtttgtactgattttcaattattttg

SEQ ID NO: 260 - DNA, 599 bp, Homo sapiens
cttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaaggtaagtctaatgtaagacagtactgcccagcttgtcttcttctggggcagtgctatctaacagaactttctgcaaagatgggtatgctgtatatccatcctttccagtatcatagccacttgccacatrtagctattgagttcttgaaatgtaaatagtgtgatcaagaaactggatttttaattttatagaattttaattaatttaaatttaaataaccgcatgtggctagtgactaccacattggacagctagacagtgcagcttgggagtcttgttttgtttttttactcaactgcacaataattttgactttaccccctgacatttttatgctatctgcttgatccaatgtgctgaaccattaacttttctttttttagtggttagttacattttggaagttttttgtgattatgaatagaaag

SEQ ID NO: 261 - DNA, 599 bp, Homo sapiens
ttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagwatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctaca

SEQ ID NO: 262 - DNA, 599 bp, Homo sapiens
aaaacccacgagtatttcaccctctataaaaaaatgttaaatgtacccttcccaaaaagaaatacctataaccaattcctgtaactattttccaaccttgtatgaataatgttgtaatcctgctaaaggaaactcctctgtctctgcctacataaatgaaaccttaacttctctactttagaatactgactctgtatctttggagttgatgtttccgggtgggctatcctcaaattttgcacttgtataagctctttaaattagattcatacccttttgattattttaggttgacgtaargagcttgttaaacaaaaaattggggaaggccatggttttgcactgaacttctgcactgggtcccagcagaccagaacaaactaatggagctgctcatactaaatgccacataatcaaactgaaacttcaaggaagcagataaattccaaagcagaccattgtttcctttgaaaacagatttcagtctacctgagtcagcacaataaggaagtcccctctactttaatccttacaaaaaagtaacccgatgttaaccttttttctctatttttctgtttcccaccttaaaaaaccccttg

SEQ ID NO: 263 - DNA, 599 bp, Homo sapiens
ataaatgaaaccttaacttctctactttagaatactgactctgtatctttggagttgatgtttccgggtgggctatcctcaaattttgcacttgtataagctctttaaattagattcatacccttttgattattttaggttgacgtaaagagcttgttaaacaaaaaattggggaaggccatggttttgcactgaacttctgcactgggtcccagcagaccagaacaaactaatggagctgctcatactaaatgccacataatcaaactgaaacttcaaggaagcagataaattccaaarcagaccattgtttcctttgaaaacagatttcagtctacctgagtcagcacaataaggaagtcccctctactttaatccttacaaaaaagtaacccgatgttaaccttttttctctatttttctgtttcccaccttaaaaaaccccttgttctgctattgtccagtgggatttctcattctactttatagaatgaagggcttccctgatgaatggtggataaaaggcaattaaatttataactaaatatgttgtaattttgtcttctgacaagctaaattagcattatatagtccaatca

SEQ ID NO: 264 - DNA, 599 bp, Homo sapiens
aatcttccctttagcataacagagttataagaaacatgaagacaggaaggtgggggtgtgtgggggtggggcgaagcttttttgtccctggaggatggtgaaaagattacaaaaagaaaacagaaggattcctcttccttcagaggaagaaagggaagtgtcataagtgagggggaagacttaggacccagaagggagggtttttagtctccagtgtgcaatcttggactttaggaagaggctgcacatcaagtggattgttgactgcctttggcaggcactagttgcagaagaaatacrcaatcaaaggaatgcagcactctgcaaagaaaagcagaattcaaagagtatttcttgaatttctcagtgtcacagatcacaaaaaaattccggaaaacaaagatattattagataatccagtattcctgaattcttaaatttccattcctgtttaaacataacatttctgtaatttgcagtcaagagtcctaaataatgttagaaagtataatttaaaaaatattaacattggccttgcaggcagagacattagtaaaatcttgtttcagtgacctggctctctctgggcactttgatt

SEQ ID NO: 265 - DNA, 599 bp, Homo sapiens
ttatactttctaacattatttaggactcttgactgcaaattacagaaatgttatgtttaaacaggaatggaaatttaagaattcaggaatactggattatctaataatatctttgttttccggaatttttttgtgatctgtgacactgagaaattcaagaaatactctttgaattctgcttttctttgcagagtgctgcattcctttgattgtgtatttcttctgcaactagtgcctgccaaaggcagtcaacaatccacttgatgtgcagcctcttcctaaagtccaagattgcacacwggagactaaaaaccctcccttctgggtcctaagtcttccccctcacttatgacacttccctttcttcctctgaaggaagaggaatccttctgttttctttttgtaatcttttcaccatcctccagggacaaaaaagcttcgccccacccccacacacccccaccttcctgtcttcatgtttcttataactctgttatgctaaagggaagattacattttcagaggatggaaagctatcatctcactgaaaaatcccatttttgaatggtagattatgagtattcgcatagtatttcacc

SEQ ID NO: 266 - DNA, 599 bp, Homo sapiens
aaaaaagcttcgccccacccccacacacccccaccttcctgtcttcatgtttcttataactctgttatgctaaagggaagattacattttcagaggatggaaagctatcatctcactgaaaaatcccatttttgaatggtagattatgagtattcgcatagtatttcaccttacagccctgcaaaacaaaatggtagtccccttctaatatgacagttgcgtcaaatctcagaaaaggtgatacgtttggaaaggcaaaggaagaagaccacatcaccctttaaagaattattcttacayatttttggtcattattagccttatttaagctctgcagactctcttgttttctgctgttaatagtttgagatcctgaaagtctcaagccaaaattgtttccaagagtaatctcactgattcagatataaatttaatacaatataaggcatataccttgcagtccttcccccattaaggctaagccatgggacttattgcaagggaaagggagcagtgatattagagaaggtcacagtataggtcagtagttctcaaagtgtgtttccccaattagcaatatcaacatcacctgggaactt

SEQ ID NO: 267 - DNA, 599 bp, Homo sapiens
ggaactgggtacaaaggagactttatctgcaatgttttgtgtaattttaaattaaacaaaataagataaaacatcaactactattgattctaggtgttgatgtctatatattttcatactctatatttagtttagttttttttaattgtatttcaatctttttttttgtctagcttttcaaatagaatgtatttacacatctctaaccattcatccatccatccattcatgctacttcgtagatatatcttgtgtggctgaccagatcttatttcctctggaaggtggcctttggaagcygcaattgtgtttgccacccaagtcactggacctttcccaaaattccaggccaccacttgacctaaccacattcatttcgatgcaagtccctggcattgggtctttatgaggcgcagatggtctccaggtcagcactgagccctgtctctttctctctgtgcccagctggcatgaattggaaggcagaggaaccgagggagttctgagtcacctagcttgactgagtcagagatttctccagggagtggtggaaagggtggctcttggcagaagagatcctcatctcaatggtgtggtac

SEQ ID NO: 268 - DNA, 599 bp, Homo sapiens
caattctagaagcatcattcaactcttacagctacttagagatgctgaaccaggttcccaagccagaacaagttggagtatttgtaccaacttgttttatttcacaccaaaatattttgccattgataaagtatacatcaaaatgtctttagtttaaaccatcccatgtataacatgcatgaaaactatctctatagacagtgaatggtgtaaaaggagtattgggccttatgaactagaagacagagtctactgccaatgtaacagcgagctctgctttccctttctttctaacagaaycctgattttgtgtttagatagtggccagaggtatctttcccatgcctcttttatttcctgatttaggttttctgaggtctgatgtctagagctgtggtagccagcttgagactgtaaaatgacacacataaggaaaaaaagtcttgttgtaaaaatgaaacagaggaagtaggggaaaaaaagcctgtgtctttctcaggaccattgagtaattgcaacattgtgaaaaactacttttagatttcttgatgtacgagaaaaattaattcctacttgtgaaaatcaaggttactaagttg

SEQ ID NO: 269 - DNA, 599 bp, Homo sapiens
aattaatttttctcgtacatcaagaaatctaaaagtagtttttcacaatgttgcaattactcaatggtcctgagaaagacacaggctttttttcccctacttcctctgtttcatttttacaacaagactttttttccttatgtgtgtcattttacagtctcaagctggctaccacagctctagacatcagacctcagaaaacctaaatcaggaaataaaagaggcatgggaaagatacctctggccactatctaaacacaaaatcaggattctgttagaaagaaagggaaagcagagctygctgttacattggcagtagactctgtcttctagttcataaggcccaatactccttttacaccattcactgtctatagagatagttttcatgcatgttatacatgggatggtttaaactaaagacattttgatgtatactttatcaatggcaaaatattttggtgtgaaataaaacaagttggtacaaatactccaacttgttctggcttgggaacctggttcagcatctctaagtagctgtaagagttgaatgatgcttctagaattggaagtaatatggctcatagaaaaaaggtgac

SEQ ID NO: 270 - DNA, 599 bp, Homo sapiens
ctatttaccagcaggtgtgcctcttttgtccagcagagacctggaagagagagctgggaacccaataccagcccctgctagggctgctgcttcagctctgacgtgaaaggcttcagtttaaggtaggaaagcaatgtgttttcttcacaaagctggtagactcttatcatataggcttctcagacatcttagattgcaggccacaggcccacacctgctctcttagctgtcagaatgactagctttagtatgaattcatttctttcaagtaggactttgcaaaactcagcaataagaaayacgcacattttaaatttttctattacttcccttgatgctgcagctacaataagcacaaaaatataaatatttaataaccacattaaaaaggtcatcaacttcgcagcttgtaatgggtgagacctgtctacttctctaccttgtattcctggagatttcacatttttattccttttacttgcaatatcccactttcaggtaccccattttgcatcagaggagagggtgcaggcaagcagtagaaaacccactacagtggcttaaccagatgaggttttttttagtctgtgtaggctgct

SEQ ID NO: 271 - DNA, 599 bp, Homo sapiens
gtctttagcatgtagcttctgttctaatggccacaggatgcctattttacatttgcccacgttactggtagaaagtatgaagaagaattgcatgtttatcaggaagcaaaacttttccccagaaattcccagcagactgttgttatcgacattccattgatgagaactgtttcatgcagaggcccgtaactgaagggcatggggtgctagttgagttttgtagcttgggacaatttttcttggaacaaaatttgaatgctgttagtaaaggggaagaggctaatagatattgggaagatraatctcagggtttgttatagggttcctccagataggctgattataacactcacaagcattattcagtacaattaaaataaatcaggagcggggaaggctcctaatattctggatttataagtctttgaaattttagtttaatccacagaattcttttaaagtttcctccaaaacattttttttctgtatttctattctccacaaatatttttttctgcatcagaacacaatttgattgaacactaactctgatattcagagacagcatcagattttggtcactagtactagtctttatg

SEQ ID NO: 272 - DNA, 599 bp, Homo sapiens
ttactctctcggagtcctcagcatctcaggaatgagctgcaataccacattgtgccagtagatgacgacaccatctaacatgtgaggactccttacccgaaatcccttaaatttcaagcatcgaattagaaattattttctgttatcaagtatgttagtttgacttcctaccagttgattttagaaatgagaaacatatattgaaatagtaacattaaatatcagaatttggtgtgtatttgtctttcaattagtggtaatttctgcaaaatgaaaatcatcttcaaggcaatgcaaatratttattataggcgagcacaagtttccaggtgaaccaactgttttgtgaaggagccagaggaaaactgattagatgagtttaactgttgtggccacaaagtcttatggcagccactggttttcaatcttgactgaatattgaaatatatttgtactaactgcccagattatattgaaataatgtaggcagttaaaaaaatacctgtctggttcttaactcaaaaaacgctcatttaattggtctacagtacggtctgagagtcaagccttttaaacgcttcccaggtgattctattttg

SEQ ID NO: 273 - DNA, 599 bp, Homo sapiens
agatgagtttaactgttgtggccacaaagtcttatggcagccactggttttcaatcttgactgaatattgaaatatatttgtactaactgcccagattatattgaaataatgtaggcagttaaaaaaatacctgtctggttcttaactcaaaaaacgctcatttaattggtctacagtacggtctgagagtcaagccttttaaacgcttcccaggtgattctattttgcagcccatattgagaacacctgcccttggcttaaggctcccatcaccccatgttgcaattagttgcttaaaygggccgatctcacccaaatacagagttggtgattatctaccaggtgtaatctgtgaaactaggaaggcccctgctcctccttaggaaaaaaaccatggtgtctgcacatctaccatcatgaatgcatttcttcgttgcacagatagatggtaaaacaaaccaatcacaaactaacagaaaaattcaggagaatcacactctgagctttattcaacattgctattaatttgttttaattgtgtttcaatgaatgttctttgtgtgaaagggacataagggaagagagttttggagtttga

SEQ ID NO: 274 - DNA, 599 bp, Homo sapiens
tgtctacatcacatataaggcaacccaaaaaacaagagtgtgtttcaataacttggccaaggtcactgtactagtccatttttatgctgctataaagaactgcctgagactgggtaaatcataaacgaaagaggtttaattgactcacagctccaaagagctgtagaggcctcagaaaatttacatcagggcagaaggaaaaagcaaacacgtccttattcacatggtggcagtaaagagaagaatgagaactgagtgaagggggaagacccttatatatccatcagatcttatgggaamttactatcacaagaacggcatgggggaaaccgcctccgtgattcaattaccttccacttggtccctcacatcgcacgtggggattacagaaactataaaatgagatttggctggggacgcagacaatccatatcaatcgcttaactggtaagtggcagagctgcaccatttggggttccaaccaatgcatttcacccttctcattcatgtttgctgcccttatgaactgaatgcctccaagtccgttagctatatttccttatttattatttggaaatgttaatgcccctacatcttag

SEQ ID NO: 275 - DNA, 599 bp, Homo sapiens
atgagaactgagtgaagggggaagacccttatatatccatcagatcttatgggaacttactatcacaagaacggcatgggggaaaccgcctccgtgattcaattaccttccacttggtccctcacatcgcacgtggggattacagaaactataaaatgagatttggctggggacgcagacaatccatatcaatcgcttaactggtaagtggcagagctgcaccatttggggttccaaccaatgcatttcacccttctcattcatgtttgctgcccttatgaactgaatgcctccaagtcmgttagctatatttccttatttattatttggaaatgttaatgcccctacatcttagagttgtactgagaaatacaaggtacaacatatttaaaagtgctcagagcacagcacgaaggtcacactgtttagatcccagtgcggtgcgtcctgttattatctttctgacacttagacattactgcctctctagactcattgctatgatctgaatattttgtcttcccaaaatacatatgtgaaatctttattttattttattttattttattttaccttttctatgtttagatatttaaaaa

SEQ ID NO: 276 - DNA, 599 bp, Homo sapiens
aaactataaaatgagatttggctggggacgcagacaatccatatcaatcgcttaactggtaagtggcagagctgcaccatttggggttccaaccaatgcatttcacccttctcattcatgtttgctgcccttatgaactgaatgcctccaagtccgttagctatatttccttatttattatttggaaatgttaatgcccctacatcttagagttgtactgagaaatacaaggtacaacatatttaaaagtgctcagagcacagcacgaaggtcacactgtttagatcccagtgcggtgcrtcctgttattatctttctgacacttagacattactgcctctctagactcattgctatgatctgaatattttgtcttcccaaaatacatatgtgaaatctttattttattttattttattttattttaccttttctatgtttagatatttaaaaaaaattttccataagacattggggtacagatggtatttggttacaggagtaagttctttagtggtgatttgtgagattttggtgcacccatcacacaagcagtacacactgcactttatttgtagtcttgtatgcttcgtccctct

SEQ ID NO: 277 - DNA, 599 bp, Homo sapiens
gaaggtcacactgtttagatcccagtgcggtgcgtcctgttattatctttctgacacttagacattactgcctctctagactcattgctatgatctgaatattttgtcttcccaaaatacatatgtgaaatctttattttattttattttattttattttaccttttctatgtttagatatttaaaaaaaattttccataagacattggggtacagatggtatttggttacaggagtaagttctttagtggtgatttgtgagattttggtgcacccatcacacaagcagtacacactgcmctttatttgtagtcttgtatgcttcgtccctctcccactcttcctcccaagtttccaatgtccattgtatcattcttatgactttgcatcctcatagcttgactcccacatatcagtgagaacatgcgatgtttggttttccattcctgtgttacttcacttagaatacatatgttgatatcttaatcctcaaagttatggtattaggagctggagcctttgggagatgactaggtccttagtgcagagcaccctcatcaatggaattagtgcctttataaaagaggccccagaaaagc

SEQ ID NO: 278 - DNA, 599 bp, Homo sapiens
ccagtgcggtgcgtcctgttattatctttctgacacttagacattactgcctctctagactcattgctatgatctgaatattttgtcttcccaaaatacatatgtgaaatctttattttattttattttattttattttaccttttctatgtttagatatttaaaaaaaattttccataagacattggggtacagatggtatttggttacaggagtaagttctttagtggtgatttgtgagattttggtgcacccatcacacaagcagtacacactgcactttatttgtagtcttgtatscttcgtccctctcccactcttcctcccaagtttccaatgtccattgtatcattcttatgactttgcatcctcatagcttgactcccacatatcagtgagaacatgcgatgtttggttttccattcctgtgttacttcacttagaatacatatgttgatatcttaatcctcaaagttatggtattaggagctggagcctttgggagatgactaggtccttagtgcagagcaccctcatcaatggaattagtgcctttataaaagaggccccagaaaagcaaaatgggtaactgagatgat

SEQ ID NO: 279 - DNA, 599 bp, Homo sapiens
aagttctttagtggtgatttgtgagattttggtgcacccatcacacaagcagtacacactgcactttatttgtagtcttgtatgcttcgtccctctcccactcttcctcccaagtttccaatgtccattgtatcattcttatgactttgcatcctcatagcttgactcccacatatcagtgagaacatgcgatgtttggttttccattcctgtgttacttcacttagaatacatatgttgatatcttaatcctcaaagttatggtattaggagctggagcctttgggagatgactaggtycttagtgcagagcaccctcatcaatggaattagtgcctttataaaagaggccccagaaaagcaaaatgggtaactgagatgatgaatatgttgatacattcatctgttccctgtagtaaccatcttactatatatgtatcctacaacatcatgttgtatgacttaaatgtgcacaataaaattgtttttttaaaaaagaaatagttccattcaaataaataatttgtattaagtaaatataaaaggcctcagagagctgctttgttcctttcgccatttgaggacatagctagaaggtg

SEQ ID NO: 280 - DNA, 599 bp, Homo sapiens
gattttggtgcacccatcacacaagcagtacacactgcactttatttgtagtcttgtatgcttcgtccctctcccactcttcctcccaagtttccaatgtccattgtatcattcttatgactttgcatcctcatagcttgactcccacatatcagtgagaacatgcgatgtttggttttccattcctgtgttacttcacttagaatacatatgttgatatcttaatcctcaaagttatggtattaggagctggagcctttgggagatgactaggtccttagtgcagagcaccctcatcartggaattagtgcctttataaaagaggccccagaaaagcaaaatgggtaactgagatgatgaatatgttgatacattcatctgttccctgtagtaaccatcttactatatatgtatcctacaacatcatgttgtatgacttaaatgtgcacaataaaattgtttttttaaaaaagaaatagttccattcaaataaataatttgtattaagtaaatataaaaggcctcagagagctgctttgttcctttcgccatttgaggacatagctagaaggtgctgtctatgaattagaaagccctt

SEQ ID NO: 281 - DNA, 599 bp, Homo sapiens
cttatgactttgcatcctcatagcttgactcccacatatcagtgagaacatgcgatgtttggttttccattcctgtgttacttcacttagaatacatatgttgatatcttaatcctcaaagttatggtattaggagctggagcctttgggagatgactaggtccttagtgcagagcaccctcatcaatggaattagtgcctttataaaagaggccccagaaaagcaaaatgggtaactgagatgatgaatatgttgatacattcatctgttccctgtagtaaccatcttactatatatgyatcctacaacatcatgttgtatgacttaaatgtgcacaataaaattgtttttttaaaaaagaaatagttccattcaaataaataatttgtattaagtaaatataaaaggcctcagagagctgctttgttcctttcgccatttgaggacatagctagaaggtgctgtctatgaattagaaagcccttaccagacactgaatctgttgacaccttgatcttagacttcccagcttctaaaaccatgagaaactaatttctattgtttataagccacccagtttattttgttatagcagcct

SEQ ID NO: 282 - DNA, 599 bp, Homo sapiens
tcctcaaagttatggtattaggagctggagcctttgggagatgactaggtccttagtgcagagcaccctcatcaatggaattagtgcctttataaaagaggccccagaaaagcaaaatgggtaactgagatgatgaatatgttgatacattcatctgttccctgtagtaaccatcttactatatatgtatcctacaacatcatgttgtatgacttaaatgtgcacaataaaattgtttttttaaaaaagaaatagttccattcaaataaataatttgtattaagtaaatataaaaggccycagagagctgctttgttcctttcgccatttgaggacatagctagaaggtgctgtctatgaattagaaagcccttaccagacactgaatctgttgacaccttgatcttagacttcccagcttctaaaaccatgagaaactaatttctattgtttataagccacccagtttattttgttatagcagcctgcacatactaagacacccagaaaacctccaaaaattttaaaccacttaaataatatgattatttaaacaaagaaaagcatgagcaaaaagtctgaaaattttattcattcac

SEQ ID NO: 283 - DNA, 599 bp, Homo sapiens
gatgaatatgttgatacattcatctgttccctgtagtaaccatcttactatatatgtatcctacaacatcatgttgtatgacttaaatgtgcacaataaaattgtttttttaaaaaagaaatagttccattcaaataaataatttgtattaagtaaatataaaaggcctcagagagctgctttgttcctttcgccatttgaggacatagctagaaggtgctgtctatgaattagaaagcccttaccagacactgaatctgttgacaccttgatcttagacttcccagcttctaaaaccawgagaaactaatttctattgtttataagccacccagtttattttgttatagcagcctgcacatactaagacacccagaaaacctccaaaaattttaaaccacttaaataatatgattatttaaacaaagaaaagcatgagcaaaaagtctgaaaattttattcattcacttattaggcaaacatttaataaaaatctgatatatactagctattgcagtaaggatacagagttaaaagagtcatagattccacctgatatggttcagctgtgtccccacccgaatctcatcttgaattgc

SEQ ID NO: 284 - DNA, 599 bp, Homo sapiens
taagacacccagaaaacctccaaaaattttaaaccacttaaataatatgattatttaaacaaagaaaagcatgagcaaaaagtctgaaaattttattcattcacttattaggcaaacatttaataaaaatctgatatatactagctattgcagtaaggatacagagttaaaagagtcatagattccacctgatatggttcagctgtgtccccacccgaatctcatcttgaattgcaattctcatagtccccatgtgtcaggggaggaacccagtggaaggtaattgaatcatggaagtgsttacccccatacttctgttttcatgatagtgaatgagttctcacaagatctgaatggttttaaagggactttaccccgctttacttggctcttcctcctgctgccatgtgaataaggacaagtttgcttccccttctgccatgattgtaagtttcctgaggccttcccagccatgtggaactgtaagtcaattaaacctctctcctttataaattacccagtattgggtagttctttacagcagtgtgagaagagattaatacactacctacaaggagcttatagtaatagctcaggca

SEQ ID NO: 285 - DNA, 599 bp, Homo sapiens
ccatgttcttctgcctgcttttattctggccacactggcagctggttagatggtgcccacacagattgagggtgtgtctgcctctcccgtccactgactcaaatgttaatctcctttggcaacaccctcacagacacaccaggaacaatacttcgcattcttaaatccaatcaagttgacattcaatattaaccatcacaactattcagagtaactcataataactaaggtttattgagtacttactatgtgccagacattgtgctccatgctttatggtttcaaattaatcctcagaarttccttatgaagtaggtgtccacaatatttccacacagaaatgagaaaacgaaagcacagaaaggtaaaataacttgttgaagttcttacagctaggaaagggtaaaaacacatctggatctagacaatctgactccagaacctggaaagaagcatctaagtgatcctgggaggatccatgtgagatgctaggaggccatgagctttgaatatatgcatattttcatttttaaagcgctcaaacaagtttgtgtattgaaatcctgtgatataagtgtttgctatcttcattttagtat

SEQ ID NO: 286 - DNA, 599 bp, Homo sapiens
aggtcaaggtcataaatggaatgtttatgactaacatagatgttaggtgcctcaatgaagagtttaaaattgatgccaaattcagtttcaggccctgatatgagctctgataaggtggggtgatggtgggatgggtgattctctgtgtctattgtgcagtctgtgcctaacggactggtccatgtgctgtgctttaggacctttggttatgtcaattatatgaagacatgctttttgacatcaaaagtaacctttcattggagtccaaatacaggcctacgtatttcatacttggtgatrgatttgagtggtgttcaaattctcccacctcaaataccttgatagccccactcagtaattcaagactgaaaatttatcattaatgctcttgttggttcaatggattgcaccttttaaaatgtgaacatccctcctagaggggaaagatcactttttagaatgttgtcagttattgaattggtttaacagtctcttcctagtcaggtgactaaatgctcccccaaaagaaaaaaagaaagcagaggcttcttatttacagatgtaagtgtgaactgaagagttaagaagagtattaacac

SEQ ID NO: 287 - DNA, 599 bp, Homo sapiens
atatgagctctgataaggtggggtgatggtgggatgggtgattctctgtgtctattgtgcagtctgtgcctaacggactggtccatgtgctgtgctttaggacctttggttatgtcaattatatgaagacatgctttttgacatcaaaagtaacctttcattggagtccaaatacaggcctacgtatttcatacttggtgatggatttgagtggtgttcaaattctcccacctcaaataccttgatagccccactcagtaattcaagactgaaaatttatcattaatgctcttgttggtwcaatggattgcaccttttaaaatgtgaacatccctcctagaggggaaagatcactttttagaatgttgtcagttattgaattggtttaacagtctcttcctagtcaggtgactaaatgctcccccaaaagaaaaaaagaaagcagaggcttcttatttacagatgtaagtgtgaactgaagagttaagaagagtattaacacagagagggaagggatttcttttagttcattttgtgttgctataaagaaatgcctgaggctaattatttgacacacaattctgatgcctggaaagttc

SEQ ID NO: 288 - DNA, 599 bp, Homo sapiens
gtgagccaagattacaccactgcactccagtctgggcaagaagtgagactctgtctcaaaacaaacaaacaaaaaactcacagaatgagaattcacccttccctaagaaaaggcattaatccatttatgaaggatctgcccccatgacccaaccgcgtcctaggaggcccaaccttgaatatcaaatttcaacataaggtttggaggggacaaatatccaaactataggaggcactagggccagaaagctcattccacaattctgccctgaacacctgcaaaggctgatgtcacggggaytaaattcaattaaggaaggctttctctttcactgaggaagtgactacatagaaataagtggatatcttgctgccattctttgccattcagtctattcgctatccagtagccagagtaattttgatgaagtataaatggaattatgtcactcctgtctttgaaatctttcaatagctccaagttgtccttaaaattaattactgcaggtatccttcccatggcctgccaggcctacttgattctctgcctgtttcataaatctcagtttacaccagtctctttctttgcactgtagtctc

SEQ ID NO: 289 - DNA, 599 bp, Homo sapiens
ctgctcttgcatctggtcctgattcctctctggcatccagacttgggtttccagcctctggtccattccataaagtgcttgttatccctttaatacattccctatattgcttaagtaacccgaattgtttcctgttacttgcaaatgaagactcttatctgagaagtattcccctgtgaatctttgaagtctcattacattttaccttgttttgttgtaatttgtatatttgcaaggccagatgctatcttttaaaagtctgttcacatatttttttctcccacaagacctttcttaatrtgtctacttgttaatttttctattattcaaactatgactgatggtattaataaccaagagtcattatttgaatatagatctctcattttcctttcaagactccaacagaattaaatcaactttcttagtggaatgatagctggctgatctaactagtttcattaactaaactcaccagaaagacatatgcaaaccgcctaccaggtaaagatatttaaacaagtaagaggtcttctcaatatacaacgctttacattcccagaggtaaccaaacaagggagacaaggatgtcagattga

SEQ ID NO: 290 - DNA, 599 bp, Homo sapiens
ttcacatatttttttctcccacaagacctttcttaatatgtctacttgttaatttttctattattcaaactatgactgatggtattaataaccaagagtcattatttgaatatagatctctcattttcctttcaagactccaacagaattaaatcaactttcttagtggaatgatagctggctgatctaactagtttcattaactaaactcaccagaaagacatatgcaaaccgcctaccaggtaaagatatttaaacaagtaagaggtcttctcaatatacaacgctttacattcccaraggtaaccaaacaagggagacaaggatgtcagattgaagggtgcttaatggagtctttcagggatttcctcctggaaggtcaaagaacactctacatctgtggcagcccaacctacctacacacaggctctgaatgaataatagatgttttatatgcagcctccttgaccttgaatttattatttccattctataggtaaagaataaatggctcatggaacttcaatgacttggaacactgtattctgaatttatcaaggtctctaaatcctgatctttttccacctaacctcattaaa

SEQ ID NO: 291 - DNA, 599 bp, Homo sapiens
tcattatttgaatatagatctctcattttcctttcaagactccaacagaattaaatcaactttcttagtggaatgatagctggctgatctaactagtttcattaactaaactcaccagaaagacatatgcaaaccgcctaccaggtaaagatatttaaacaagtaagaggtcttctcaatatacaacgctttacattcccagaggtaaccaaacaagggagacaaggatgtcagattgaagggtgcttaatggagtctttcagggatttcctcctggaaggtcaaagaacactctacatmtgtggcagcccaacctacctacacacaggctctgaatgaataatagatgttttatatgcagcctccttgaccttgaatttattatttccattctataggtaaagaataaatggctcatggaacttcaatgacttggaacactgtattctgaatttatcaaggtctctaaatcctgatctttttccacctaacctcattaaaatgttgattaatgataagaggtagcagatgctaaaaggaatcatcatagggagtgtcaagtgaagactgaattctaataccagccctgccactgtcca

SEQ ID NO: 292 - DNA, 599 bp, Homo sapiens
tcctgatctttttccacctaacctcattaaaatgttgattaatgataagaggtagcagatgctaaaaggaatcatcatagggagtgtcaagtgaagactgaattctaataccagccctgccactgtccagctagttgggtcaccttcgggcagtcactcagtttgttacaggctttagttttattatttatattaggttgaagtctatgaagttgctgtttttgcaggttacaaaaggttagagttcaacaatttgagtaaaatgagactgtaggatgaatataacaacatgatttgttwttgtctattattttccataattacaatttgtgctatgatctaaatgtgtccttcaaaattcatatgttgaaacataattgccagtgtgataaaatgaattataatgtaaaaagatagagcctttaggaggagattaagttatgattataaatggaattactgaccttataaagagctggagggaactaactaggccctttattgcccttctgccttctgcaatgtgaagacacagcattcatgtcttttgtccgtttgccccttctgccatgtgaagatgcaacatgaatgcctaactc

SEQ ID NO: 293 - DNA, 599 bp, Homo sapiens
aagactgaattctaataccagccctgccactgtccagctagttgggtcaccttcgggcagtcactcagtttgttacaggctttagttttattatttatattaggttgaagtctatgaagttgctgtttttgcaggttacaaaaggttagagttcaacaatttgagtaaaatgagactgtaggatgaatataacaacatgatttgtttttgtctattattttccataattacaatttgtgctatgatctaaatgtgtccttcaaaattcatatgttgaaacataattgccagtgtgataawatgaattataatgtaaaaagatagagcctttaggaggagattaagttatgattataaatggaattactgaccttataaagagctggagggaactaactaggccctttattgcccttctgccttctgcaatgtgaagacacagcattcatgtcttttgtccgtttgccccttctgccatgtgaagatgcaacatgaatgcctaactcaccataccctgaatctgcaggcaccttgatcttggacttccctatgtccagaacagtaagaaataagttgttataataaattacctggtctca

SEQ ID NO: 294 - DNA, 599 bp, Homo sapiens
atgattaatggtgatgacattgcaaggtcaggcaagtcagttgattccttgggagctgcattacttagtattgacatgggatgattccacccaaccagaagcacagtatgataattttctattgtttctatgcaatacatcaaggctttaaaacttgcataccgaaggcaaggaagcagtgaatgctagaatagcacactgaaatcttacttcatgtgaaaaattaaaataaggataaacaggaagaacccagggaattgatctgaatttcattttccttttgccttttatcccaattayaggaccatttccaggagtggctgtctcatggaaagcccaggagtcttttgttgtaatcaggacaggaagcctaatgctttaggatgctgtaattacgttttccatgagtgttttctcaggggactggcttcagaactcagaaaattctcctcaaggaaatgaaattgttctgatttaaaactcatggtttccactgaaactcgagtggtctttagcttcagaagtttaggacaggaagtgatgggtagaattgaataaacctgagggtgaatgaagtgggagatgccatcttttaactg

SEQ ID NO: 295 - DNA, 599 bp, Homo sapiens
tgcagcaagaaatcagagaaataatgagaatggctttaggttctcataaggcaagtgtggtagattatcttttccaagatggccctaacaatatttctcattctacatgcgtttttgcaatgttacttctcccactctgccattaggaaatgagatctgtttcccatacccttgaatctggctggatgacctgaagcagaagtgatgccatataacatctaaggctgggccttaagagatccctgccttctgacttcgctactgagaatagttctccttggaaaccagctaccatataakaaatcatgctaccatgagaccaccattttgtgaggaagtccaagctacacatatgaagagaaacaggatacaagagaagcacaaaaatacaacatataaatacgtaaataaagccttcttggacctctaaggaactaacttaactcagttgactgagtgacctggccaatgtcaccagtaaggcctgcttgaattcttgacccttagaatcatgagcaaataaaatggtggttgtgttaagtcactacattttggtatagtttgttacactgcaatagaaatggatgaagaactcagca

SEQ ID NO: 296 - DNA, 599 bp, Homo sapiens
ttcttatatggtagctggtttccaaggagaactattctcagtagcgaagtcagaaggcagggatctcttaaggcccagccttagatgttatatggcatcacttctgcttcaggtcatccagccagattcaagggtatgggaaacagatctcatttcctaatggcagagtgggagaagtaacattgcaaaaacgcatgtagaatgagaaatattgttagggccatcttggaaaagataatctaccacacttgccttatgagaacctaaagccattctcattatttctctgatttcttgctkcagagcacttcatgggaatgactgaaggcttaattgcaactgcacagcaattccatgtctccctctgcttccccagcttcctctatgagattgtggctgagaccactccctagtaaacttcctgcacacaattctccacctcagattctgtctcttgggaattaacctaagaaaaatgttttcgtgtatttttccctagtgagagaactgctcttctgtcagagacatctctttattctctaggaagataagcactagggtaggcatgcaaaggagtcatttttgaatatccaaattag

SEQ ID NO: 297 - DNA, 599 bp, Homo sapiens
aacactttaaaaaatagctagaggaaagagagcaaaccaggagcagtggctcatgcctgtaatcccagcactttgggaggccgtggcaggagaattgcttgaacccaggagtccgagtccagcctgggcaatacagtgagattccatctctaaaaacagaaagagaaagagagagaagacatttaatacacacaggacaactaaacaaaggcacattgggaacaataaactaagagcccaaactgaagtggtagctttggatttagagaaagaaatagttcaatggggtataaataacayaatttagtgatttgttgaatttggagagcaagagagaaggaggggtctaggacaacccaaggtttgtattattaagagagatggtaaatttgtgagagtgtgtgtgtgtgtgtgtgtgtgtgtgttagcataagactaaacagctttaaaaagataactgacaataatccagtagcttacctgagataggcctttaaatacagcttcttacaccttagttcaaggtcagcattccaggttggtgcgtagctctgcttcttattcagtaacccaggttcctaggttgctcttccattcct

SEQ ID NO: 298 - DNA, 599 bp, Homo sapiens
aaaaattttaatactgactgctgataaaactctaaaattaacatttcttccatccctctgtctttccttcattccttctccctctcacacattgccttgaaggagtaatacttgatagatagtaaaaaaattaaagtacaaaggtatatggtaaaaacaggttgatggctcatcaccagtctcttgtctctctccccataggcacctgctggggaacagccaatttaatgtgaatcattctagatatagtctatgctatacatgtgtatatacacagatgttaaatttttaatttttctsaaaggtttgcatatcacacatactttttgaaccttcattatcacatcataatatacataggagagtttctgtttaggaatatttatgtttaacagctgtgactgccattgcgtagatgtggcagcactgaacatatatcctactggtgaaaatttaggtggtttttacttttatgttactacaaacatgtggtaatatatactctagtatatattcttcatacataagggataaatatctgcagaataaattcccaaatatgtaattgctggggaatgaagtatgtatacttaccattt

SEQ ID NO: 299 - DNA, 599 bp, Homo sapiens
tatcaaattttcatgcggtgtttggttttttgttcttgcgatagtttactgagaatgatggaccagcatggcacatgtatacatatgtaactaacctgcacaatgtgcacatgtaccctaaaacttaaagtataataaaaaaaaaagctaccaaaaaaaaaattttcattttttctgtcctgattgaaaaatctggactcttttagttttattttgcatttatctattataaataaggtccagcattctttcattattataagtgccatttcgatttgactttttatattctttgcctayttctctattggacggttgattggtacaagtttattatattaatgacattagttcttattatcttttgtgctgcaactattttttcctaatttttagttattgtttgaaccaatttatgttaaaatttttgtttttaggaagccaaatatatcttattttaattgcttctggtttctgtttgattgttcagagagagaataagagttcaaaatgtttctcttattttcttttagcaatctttagtaacctcaactaccttttaaaatccacgttacacaaaaaatgctttacctgggatg

SEQ ID NO: 300 - DNA, 599 bp, Homo sapiens
aaacacttcagtgtcatctttgccagagagtaagtatgattttttgcaatgtccattatattccactggtcaatttgctaatctgtgtgccaatactacttttgtcttaagtaatataccttttaatagatattaatatctggttttgtaatatctctagtttcattctttaaaattgctgtgactgtatttagctctttgtacctctatgtgaattttgaaaccagcttgtcaggtttttttttttttgaaaataaataaataaaatacttcctaatattttgactgggacagaactamatgtatatactaatttaagaagaattgacatcaacatcttttcaccatggagttttccaatccatatgcatggtttattactcttgtcatgcatttcttttttctttttgagacagggtcttgctctgttgcccaggctgtgaatatggctgactgcagccttgacctcctgggttcaagaaatcttctacctcagcttcccaagtagctgggaccacaggtgcataccaccatgcccagctaattttttaaaattatttttgtagagatgaggccttgccatgttgtccaggctggtc

SEQ ID NO: 301 - DNA, 599 bp, Homo sapiens
tgtcaatgattttgtgtacttctaattcctctctgtcttgaacttctgagcctcataaaataaaaattacttattaggaaaaaaaaagacaattgaaaccagaccctgaggttgtacctcgtaaggttataggggactagctttgggagagtataacccgagatacagcacgtggggatctccaggggcagccctgcagtgatagccagggatcttgcaaaacccacgctgaagaacagcaacacaggttctgtaaggtgaagcataatcagtgctacaattaagaggattttccaaaamcttttaatggagaacatgtatagcttgccaaaaaggatgaaaaacaagcagtaacactcagtaatcaggtttttatgccttagtagatattcacactaaaaaaaattttactcatttcatgttttcactttttattacatctatattttttcaaatgtacatttctctcccaatcccagtgattaggatgcaattcaattttttttctattttggatagcttactgctgtcacatgaataaacttgtaaaatgtgcgcaccttttctttgccttataaaaaaaattaatctatcggtta

SEQ ID NO: 302 - DNA, 599 bp, Homo sapiens
acttgaccctgaaacacagactatgggggaagggcattccaggaagggtgaatagcacttgaataaaggcatgagatgaaattggaaagtgtgaacattttagaagaaaaaagggagaaaatatgttggcagggatggttgaaaaaagagaatagaaaaggaaaaacaaaaaagtaaattcaccttttttttttttttttgccaaagggttgtggattagtacttagctgacattctggtttaactttggtatataaccctgaggtaatcataaccattgccatggttatttaccacaaycataaccacaatcacaatcatacccatattcactgaatctttgtgaaataacagatctgtggctcttaactctatcaaactagacaccccattcactgttctttgattaaatttaggaatattaaaacctgaaaatgacatacctttaaaatcaatataatgccctaactttattaaaaatagaaaatagttcataaaattatatatagatatgtaaatattaaataagattacaacagaaaacatactgagcaagctagatatatgcactttttcaaaatgaacaaatatggattaag

SEQ ID NO: 303 - DNA, 599 bp, Homo sapiens
tctgttacatatttgcacatgaactaagcattagaaggcaggccaatagtagtgtagtgtatgggcaactcaaaatccactagcagtgttgctctccataatgcgatttcctaaaataatggtcaatatttcagttgtgtttttgaaaagtattcaaaccatgagaaatattttgtggttatattttaaagattttgtgtgtttatatgtcaagtgttttaaactcagctaattataaaccattctttcaattgcataaacatctgtcaaggtgttggaaagttgtgtttatgtgagacrattcttcaacgtgcacaactgttccttgcattgcaggacccctaacatttctcactctgtccactaaatgaaagtagcaaccactgttgttttctctgcttttatgagtttgacagctataggtatctcaaatacttcatgatttcattcatttttatgaggtatccataatcattaaactcatgaagcagagaatacagcagtggttgccagatctgggggttggggaagtggagagttgttcaatgggtataaagtttcagttacactagctaagtaagttctggagatctgctgta

SEQ ID NO: 304 - DNA, 599 bp, Homo sapiens
aagagagagagaaacaagagaaaagaggcaataattaaatactagagaaaaattctctagcttcaagacagatttgattctgcaaattgaaagttctcactaactttgagcaggagtgactggtaaaacatgtccaagataaagaaaaaaattaacaacataagtttcaaaacagaaagaatcagttacaaaagaaaaatgaaacagactgacatcagattttttatctgtgatccttgaagctggatgacatttaaataactccacaggctagtgagagaaaagatctgtgacccaatragcaagaaatcacagatggtatccacacacatctcttccaatgagaatacttaaaaaaacaaaaaacaaaaaaaccactttagccaaagaaatgaatcagaacagaaatcataatgtaaggaaaggtgaggaagaaagaaaatgatggttagaaatgaactttgcaatatatatctctctatataatgagagaatgacttgaaataataaagggctttgaaataaaatggaactctaaaataatacagattaatagtttataattaaagcacaaaatatttccctgtaacctttgggtt

SEQ ID NO: 305 - DNA, 599 bp, Homo sapiens
tgatacatttcacctagttttctaaatgtctggcataaaggtaataaaaatattttcctatgattcttgctctaatataattttaaatttcctttgcacttacaatgttgtttatccacatcttttctagttttcttttcattataattgccaaatgttgaatttaatggtctttccaaaaacagttttgattttgttgattggtgggacagatcctgaggaagatgcatactctctgataagccagaggtctctgtagcatcttcaatcaagggaggtgcaatagcctttaatagggargaatgggccacttctgcaggtggttcagggaaactgggggtttcaaatttctttagtgtgtcaaccaagaagttcccatctcaagactccttccaaaagaggacctgacctgggtttagaagcacttccaagattgagaattcagtgtttttgcaactggccagctttacaaataagtcctgtacctgatccaccactctttctgctatccagctgcagcagttgagagtttcttcaaaagctgccaaggaagcccaccagctttctcactttgcctgtagttcatgataatcaccctc

SEQ ID NO: 306 - DNA, 599 bp, Homo sapiens
aaagcttttaggcttcctggattacctcttctaacaattcacagccaaaaaacactcctaccaaagcctagaagaagataatatatttaattttgtaaatgttgaacaaggaacgaaatatgttttaggtcagaagatacagctgaggccatattgaaaagagagattaagtgaaactctgcacgataagtagcgagacccctgagggcacacgctcccagaatgttgagaaataggtttatgtctattttgcccctagccatacaactattggtggatttttcactgaacaaaataaayaacccaaggagggttatatatataacacaaaatactacaaataattccctctatatgatattcaaggaaaggcaaaactgaagtgacagaatgcagatcagtagttctccagggctaaagtgggagggaatcaaatgcaaaagactctaagggatttggggagtgatggaaaggttttatatcatggttatggtggtgattacaggattttattcatttgtcaaaactctgaattatactttttaaattgataaattttattgtacctaagttacatcttaataaaaacaattaaaatt

SEQ ID NO: 307 - DNA, 599 bp, Homo sapiens
agacccggtgctgccttaggacaaaaatagggccacaagttaagaactacctatgtagtgtgacagatcccctgccaggttgtttaagggtacatgtccactgcctgaaccctgaaggccaggcaatgagccaaggccatggtgtatagctgaggaataggtgtccctgggaacccaaacatcctggagaatagctgagaacctaccaagggaaacagtcccatcacacacacatagtaggtaaagagacagaaaattagcttagagatgggaggtggcacagatctctaaagctgtccygctgccattcaggagtgcctcatgcataagtcctaataaactcatctactagccaagctgaacttgtcccagacatgcttggtctctttgctccctcccagtttggggtaaggttttttttaaatacaattccaggtttttctcattacaattgctgtcatgagcaggatctgagaaaccaatggatgaattaggaaggcgcatctgcggggagaatcctagggtggttggcaacatgcatgtggcgtggagttgcccgactgctcaatcttcacaggccaccgtggactctgggaaaa

SEQ ID NO: 308 - DNA, 599 bp, Homo sapiens
ccatgtcccagaagccattcctacctagtatgaaggctaccacatagttggagatctggcccatgcccacgatgacaaataacacagtgaacatctcccagctgatggagaaaatctgcaggaagctgaagccagtctgtacagccatggttgcgaagagaacgttcttcctgccaaacctagagaatgcagtataacacaaaacatgagatgtgtaggttgccaaggtgtgttgcaagccctgagtcaggcatcaatgcagacttagtgttttttcagggctctggcagacttttttcyctgtcacatcctcccatcttcctccttggtgaggtctcaggcatccatctgctcaggagatatcttttgagattctcagcttcctgtggagacaccatgtctcaaaagcatggagcagtgtacgcaaggaccttgtggaaatatgctctttagaaggagccacagatagatgctaccagcacatttctggaaagtgggtacagcacagattgcagatatttcttgaatcagcaacatgaaaattctgtaaatccagaactaagagtcactctgcaagtggtttttaaccttggctgcac

SEQ ID NO: 309 - DNA, 599 bp, Homo sapiens
ggctccagaatcaccctgtgccactaaaaaggcagatctcagtgctgcccattctatagaaccggggatgccaccacctggcacaagtcccaccttgttcccattcccacggagagagcttctctggcttcaccgtgactctctacccttctgttccagatggtccttcaggtcctcctgggatatgggcctgctggtcagagtcctccgttttggggaggcctgtttggcttttggtatgtgtctggcccaagcagagccacatgttgggtttttcaggcttagggaggatcgtcacayggaagatggattctggggactttgaacatgaagacaataggctttgccttgtgttcttggagccactggggactaggaggttgcaatttctatcttaagttcctccaacctccagtttccaacaacactggcctgaagctccctgtgccctctacacaaatgatcttcaagaaaatcttgccccgctccttccccctgcaggaaggggagcagcctcctcccgctggggcctgctgaagagtgtgctacctgctgggaccatgtggctccagcatgttcttcccaccttgtctcctccc

SEQ ID NO: 310 - DNA, 599 bp, Homo sapiens
gctctcagtagaccccagctcaagaaacaagactgtagtgcagctgccaggatatgaggcgagacccaggaaccatgggctaggagtgtcctccatctggcacggggagaacctgggttccttgatgctgagttgctactagagtgactgtgataagccgtctttcatggagatattattatgaagactgagatcatgtatgcaaagtgcctaggagggtgtctggcatgtggcaggtgctcagtaatagttattctttatcctgatcaagcagttgaaatgtgctacatgtcaggggartgatggaaagtacaatgcttttgatccaaaaaggcccagtggaagacagaactcctcttcagggcttaacagatgttcccctgctcagggcttcccctctgtctgcaccaatcactccagtcaaaagtaacatttcctatctctgtgtatacccagcaatatgtgccccactcccttgacccatgtccccatgtccacagtgacagctgcattggctgcagaggcacaaccaggcagtgagctccttgtgaatagacaggagtaagttcttgctcttccctgggtctccccagttcttc

SEQ ID NO: 311 - DNA, 599 bp, Homo sapiens
tgtcataaaaatatcatgcccagccccaagagctaatcccttctgagaatgccacatttccaaaataagagccccaacatgagaagcagagagagcatttcaggagacaagcagtggctcttctgaggggccatgtggggtcaaggtgtgtgtagcctttccaacagttctgaactgtaaataaacagacattggcccatcaggaagcagtggagagttcatcatttccaagacctcagggcacacttacccatgcctgagccctgagaaatcagttggagtgagctggctctggaggtrcacagacaggccttcctgcagcatgctgtgcccagagatcagcccaggcagacacagtccacagtccatttggaccaaggaaagaaaagcaggcgctgttctgctgcccctgcaggcagcagccctagacctgtccacacacccattgaactcacagtgctttccctgaacagcagaaaggcccatgactgcttggtgcgggcactgctttttgggaaaggacatgcaggcgactattggcctctgctctgctcagtgccacagtgagcagagatggcaccagatgggagtccaagaac

SEQ ID NO: 312 - DNA, 599 bp, Homo sapiens
ccttagggcacagtgagcaggctccctgtgggatggaccttctctgctggaaactctggaggctgactctggagggctaatggatcagagctgttcgttcctcgctgtgacatatggtcccgaggcaaagatcccatccctactaatctctgtacagcccatcagaggctttatattgttattctctctctctctttctctctgatagaatcataccttaatcagattgattataactttttttttgagacagcatctcattctatctgggctggagtgcagtggcatgatcatatagckcactgtaatcttgaactcccaggctcaagggaccctcccacctctgcctcctaagtagctgggactacaggcgctcaccactgcacccagctaattttttatttttagtacagacagggttttgccatgttgcccaggctggttttgaactgctgggctaaagtgatcctcccaccttggcctcccaaagtgctgggattacaggtgtgaatcaccatacctggctaattataacattttgaaagtactggtctcttaggtcaaaatgacaactagagccagagaacatagtttattaa

SEQ ID NO: 313 - DNA, 599 bp, Homo sapiens
aggcggcagggtccatgtcagctctaagcatccctccataccccaaccactagactgatgagcatccctttgggaagacccacctgcaaggatgggatgttcagaagaaagctattttcttttataggaaaatggtaagaccactggtaaatgttcagggggagcactcagcttgtcagtgctggtcccaggctggcctctgtctggggcaagtcctgtccctggtacagtatgcccacagccaggagcattcatggaccagctcctggggaatagaagaaaaagctctccttagggcasagtgagcaggctccctgtgggatggaccttctctgctggaaactctggaggctgactctggagggctaatggatcagagctgttcgttcctcgctgtgacatatggtcccgaggcaaagatcccatccctactaatctctgtacagcccatcagaggctttatattgttattctctctctctctttctctctgatagaatcataccttaatcagattgattataactttttttttgagacagcatctcattctatctgggctggagtgcagtggcatgatcatatagcgcactgtaatc

SEQ ID NO: 314 - DNA, 599 bp, Homo sapiens
tttgggtcattgggtcattgccatggaaaggggcaataaagcctgagtgttgtcatggcaacagtaaactgacatggcacacgggtgggcgtgtcttatggaaagcgtcttctgccctggctgtgttttagctggtcctcaatttggtccagtgtccaagccctgcctctggagtcgtgtctggcctcctacctcagtaggttaggtgtattgacctagaatattctcaatttacaatgggcttattgggatgtaaccccattataagtcaaagagcatctgtacttacttagcctagamaacaaattataagtagcagacacagagtcctgtgtagttaattggccccaaacccacactaggaattagctcagagcaaaacaaatgaccaaccagcaggtcccctctccagcttaatagcacatgagttgaaaaatgagcctagtttgcatttttcagaatatgcctttagtgggtccctataggaactacaataatgttaggtcactgactctcagtaattagaactgtgctgtccgatagaaacttctgaaatgttctgtatctgtactaagacagcacccactaaccacatgtag

SEQ ID NO: 315 - DNA, 599 bp, Homo sapiens
cagctttattgaagaggcaatgttacagctccgtgactgctcctgcagagcagggctgccccacaggcagagagtagcagctcaggacagttttgcactcatatttataactacttttaattacatgtagatgaaaggtcagtttatgcagaaatttctagggaaagggtagtaatttttgggtcattgggtcattgccatggaaaggggcaataaagcctgagtgttgtcatggcaacagtaaactgacatggcacacgggtgggcgtgtcttatggaaagcgtcttctgccctggctstgttttagctggtcctcaatttggtccagtgtccaagccctgcctctggagtcgtgtctggcctcctacctcagtaggttaggtgtattgacctagaatattctcaatttacaatgggcttattgggatgtaaccccattataagtcaaagagcatctgtacttacttagcctagacaacaaattataagtagcagacacagagtcctgtgtagttaattggccccaaacccacactaggaattagctcagagcaaaacaaatgaccaaccagcaggtcccctctccagcttaatagca

SEQ ID NO: 316 - DNA, 599 bp, Homo sapiens
aaatttttttaaagtgtgtgtgtgtatatatatatatatatatatatatatacacatacacacatatatatacacatttatatatgcgtgtgtgtgtgtgtgtgtgtgtgtgtgtgtatatatatatatataaaggcactgccagaaccatgtgttttaacactgaactatattcttatttgtccataactatatatctcatatctattttatgattgctgtcatccacataggtagatccctacaactagactctaagtttcacagataggaatcaggccacctagctgataaataccrataaacaccccagcacagccctgaagggcagaagtgttagacactcccaatgttgttgttgttgttgttgttgttgttttatccatttaaattgactgagacttgaaatggacttcttgatttgaagggcaaaggattaagggatgttttgtcctggcagccctctgagagcttgagttcatggccagtctaagcctctagccatagccagagtatctgcttctggaaaaggtcctgaaggccagggactggggaagccgtgggggtgagcagtggcatgcccaccgtcctctacagag

SEQ ID NO: 317 - DNA, 599 bp, Homo sapiens
ccagacatcttcttggagggttccagggtggtgcacacagacaggacctgtggaccagtcctgtgctaatacttggtggttccacggggcccttcttaaatgcaggttgccaggttcctccctgggcttgcctacttcgactcttttaaacagaggcctgagaatctgtattcttaaagcacttgggtgattgtgatgagcagccaggattggaaacctcagaacaagaatatgcttgtatccagtggttgtccctggcctgggtggagccaccaaaatgtctttggatcaggtaccagragcaggttgaaggtgcttcttctgaagccaaggatgcttgagattgctttctaagacaatactctactctatatcttttcctatccaagttaatgctactgcctgtaacatgaagtgaaaaatcacagttgttaagagcatgtactttggtgcctgggagaactaggtcacaaatcccagtttaacatctgtgtgatcctgggcaagttacttaacttcgctgtgccttagtttctttttttgaaaaaaaaaaaaagcatgagcaatgagcagaacacagtgcctggcatttggtaggc

SEQ ID NO: 318 - DNA, 599 bp, Homo sapiens
atgaagtaccaggactttgtgactttgtggccctacagtgcatgcgcagtaagagactgatggaggagtttttattatgaagaagtgggagtgccaggcctgccttcacagcaggtcctctccaaatgtgagtgtccttttttctaggaatgatcagacacttacacagctcacagccacattgccttttctctcttgcactatttggattgtagagccccagaacatgcccccagcagaataaccctggtattataacaaagcaaagccactgcataaactagtgggaaccagacatcytcttggagggttccagggtggtgcacacagacaggacctgtggaccagtcctgtgctaatacttggtggttccacggggcccttcttaaatgcaggttgccaggttcctccctgggcttgcctacttcgactcttttaaacagaggcctgagaatctgtattcttaaagcacttgggtgattgtgatgagcagccaggattggaaacctcagaacaagaatatgcttgtatccagtggttgtccctggcctgggtggagccaccaaaatgtctttggatcaggtaccagaagcaggttg

SEQ ID NO: 319 - DNA, 599 bp, Homo sapiens
taaaaagtcactttccttacatcagactttgctcttgttaattggacgctgcaagctgtgagtgactgaacctgagtttttgttacaactgcactatgcagacacccctgtgtagaaatttgcttattattaacatgactgagaagcagaggatatctgaaaaatgacttcaggaacactagtggatctttttacacatactagacccaaattagataatacaaggactaattcataaacacaacaaataagtatgctcaagggatcttagtgattttcccatttagtaataggagtagyttagatagaactagtgactaattttttattagcttagtagcaccactacccaagaacatttgcatcagggatataggctgaaatgtaagaactaagaagcccatgtacctaggacacacttgcttaattcagacgcataagctctgtcattgatctcttctaattgccaagtaggatggcccttaaaaataaacttagattagctgcagcctaaatctaccagttctgacgatcatcgtgtgtgtgtgtgtgtgtgtgtgtgtgtgtgtgtgtgctgccatcatagagtaggaattttc

SEQ ID NO: 320 - DNA, 599 bp, Homo sapiens
taactgagtacccccatttttctaagagatagtttattttctctctctcttcttttctctttcctccttttctgcactttctacttagctctttagaagtgcaattatagccttttaacctcctcttcactggacactccctgcagggcaaattcatctaactatgtgcttagaagctccagagtggaactctcaccgcccagatttcctcaagcgatatcagtcaatttccaactcaaagtatgcctgctagagtttttggccacctatacaacctgtttctgcccatgaaggcaccamctcaactgcccagtagataaggcagcaagctagccctctgatccctcacctgctcgcgtcctcccctgccttttagaagtgcctgctttccgcttcaaaaagaggagcggtggtacccttcaggcaggaagccgatacctttctccctaagctagctttggaataaaaagtcactttccttacatcagactttgctcttgttaattggacgctgcaagctgtgagtgactgaacctgagtttttgttacaactgcactatgcagacacccctgtgtagaaatttgcttattattaacat

SEQ ID NO: 321 - DNA, 599 bp, Homo sapiens
gtaggcatctccatgtaaattaggagcatccagagacagagcaaagtaacccactgaggtcagcatcctgaaagaagaaggtaaaaatgacaaagggatggtgtgaatcgctctaaaattttatgatggtcaagaaattctctatatcttgctgtcttataagtagccactaccctcattggctacttaaatttgaataaattaaaattaaataagattacaaattcagttccttagttacactagccacacttcaagtgctcaatagccacgtgtagctagtggctactatattgaacracatagatatgaaacatttccgtcactgcagaaagttctattggacagtgctagtctagatataccaatattcaacaataacttttctcagctagttgatttcaagttttcctatttcctgaatagtttgtacctcctcaatctcttagagctattatatgaagaaaaaatattagtcacatcagtgaacataaaatccagatttcattctttaacaaaaaagagatacaagggtcatactgtgggattcacttagaataaattctgattctctttagggaaaagagtgaatgtcccct

SEQ ID NO: 322 - DNA, 599 bp, Homo sapiens
atttttttatttttagtagagacagggtttcaccatgctggccaggctggtcttgaactcctggcctcaggtgatccacctaccttggcctcccaaagtgctgggattacatgcatgagccaccacgcctgagttgcttgtgtgtttaaaaaattatatacatacctgtgtacatgatgttgtgcaaaacaaaatgtctgtagcgctactcaccagtttgtgattggctttctagagctcctcctgggagaggagaggtgaacttgtacttttttccagtacattctatgctatttgacrttttcacaatgaaaatcttacttttacattgaaaactaatttaaaggaagaacaaatgcacaagatgcagctcaccgaggtaaacaaagtagggggcaatgatgctgcccactctggaggccgtggatgtgacccccaccgccatgttcctgaccagggttgggtagagctcagcagtgaagacatacagcatggagaaagcagaggtgatcccaaattttcccagcatgaccagaccaatggataagaagtaataatctggaaaagagacccggtataaacaatggtgcttttagaag

SEQ ID NO: 323 - DNA, 599 bp, Homo sapiens
gaatggatttaaatctgaacattttcagagaaaaaaaagtaagcaaaatatcagtttctttttggcagatgacattgtgcatgtctataatccttttgcattatcataaggcttttcattctttcctgtcaactggtatcctctaagctactactcagtcatgtgtgacagatgttcctttggtagagttctttgcctaccagagttctcctcttaaggtggaggtaattggaaatgggggatgggaggacatcaaggagaaggaggttaaccaggatgtttcagggataggttttggcyatgataggtctggcatgactctgcttttgcccaaactagtaggctgcagtggaaagttaggtccacagggctatgagactcaaaaaaaaaaaaaaaaaaaaaaaaaacaactaagtattatgttcacttcagattaaatcagtaaattataagtatcaggcacattctgtaaaggcactgtgtgcctggatttggcttctttttggagcacttacatgtcttgggttaatatgtaatctctttgtgaagctttactcacacaggagaaaaacagatcctcatcttgctttgcccctgta

SEQ ID NO: 324 - DNA, 599 bp, Homo sapiens
atatatcttaagccatttttaggaaacaggaggtttagtcacgtgctcaacaaaagcacaacaaatggggagcatttaatggtgtaagggctgtgaggtgtagctgctgaaactgtagctaggagctgccttgctgccttcttgcaggcagattggccagatgagccaggctaaaatacaattaatatctaccattgtggtttaatatgaaatatggatacctggtctttgtctcagttcttgtcatagagttccccaaacctttagaacttcctgagtggtaggaatatctcattagtsataatgagcccctttgattcgataactcctgagtttatgctaatgaggttacttaatgtggggccctagatattcttaggatggggctagttcccggaaagaccaggtcatttgaggattagagggttggaacttttagctctacccactgatctctgggtggggaaggtgctggagatcaagctgcctaaaaactcttgaacaacaagatttgaggagcttccagtaaatgcgtccacaagctgggagggcactgcaccccagtttcactgggacagaagctcttgcacttggaatct

SEQ ID NO: 325 - DNA, 599 bp, Homo sapiens
gtataggtgaaggtcaagtactgcgaggctaaggtgtagcactactcatcttcctgagcacaaaagtcaccagcaccttgggctgggtgtcagagagctcacagaatgtggataaccaaccaggcagatgttggtaacagcaaccaggagggcacagcacaaacctgagcaggtcttttatgtatgtgaaggtgaaggagttatgatttagaaatggcagtgggaagcaaggagaatgctgagagcctgctcagctcttgtcttccaggatcatggatagtgcaaaatgagtagccttcmtttgagagacagagccatgaggctagtggagtgctcagaaagaagccagatctctatcaaggaaaggagatggagagaacaaccagggatgtacttgaaagaggagagttgcatgtctacaatggaatatgtgttgcagaggactcagtcacagagaagacaactgcaggagggtgagctggagggctctgcaggggcaggagcacagtagggcattagaatgggagttttagatgagaaggattacatttgcagtgctggaggaagatcatctcaaggttcacaaaatcaagctttaa

SEQ ID NO: 326 - DNA, 599 bp, Homo sapiens
gggctgctaaacttaacaatgcaagatattcctttttaaaatagtagtggcttagtgatagaaacagaactaagtgtatatttttacaatataatgtgttgagtaaagaatatttaatagtcactatattatgagttgaaaataaagctacagaaagggaacctaacctggccagcagatttttaacaaggaaatctaaacatttgcataaagcataatagacttaaaaaaattatgataaagatgttatcacaggacttgtttgtttctttatacttactattcactattcttacttcstgaagatggatggttataccttcagcaatgtacttaaatccttctaacatcttatgtgaagttatagttcttatctagaactaactgaaaaagaaagcaaagcttcttgaaaataaactccttttttgtgtgctaaaatattattttaatgcttcaaaagaaatgaaagcttttatgagaagaatgttgacctctgtccagaccaaacaagatgaagaagtcttattttaacatttgagaaatatcagttgggcatcagataacattcctgaaagggactgaaaacaatgcagtatact

SEQ ID NO: 327 - DNA, 599 bp, Homo sapiens
ccagagcccctgtaagcccctctgaggctccaggaggggaggctcagcaccaacatccagcagggcttgaagctgtgccagggcctgtggcactctccctctctatgaactctcccctctctgtgaactccgccgtcctgctgggtggtttcttgctgctgcactggggccttcagctcactattatgctgagctgaacaccctaggctcacggagaggcctcctcttctgggaagccttctctaacctgcgaattggtcatctgcacatttagtgagcctatctatcaatgagggctaytcactggctacttactcaatgctgctgaaacttcagggagctagagtgccagtgtctaaaaaagacacaaaacacatacatcattaacatcatgttcctacatccagctccaacaactgctccaacaggttcggaggggacagacaaaaccacccagagggaaaatccaaggggatgagaaatgagaaaggctcccctacaccctatgacctaaggctgtatgctttaactaaatctggccgacagccttgcctcataatacctgagaaaatattccaggtcaacaagtcaccctgaac

SEQ ID NO: 328 - DNA, 599 bp, Homo sapiens
attattcattaactcattcaataaaaattttcctgagaacctccctctgcatccagaattgtgtcagaaattgaggaagacgcaaagatctaaatccaccacaaagtttggtactacatgtatgtactttaacttgaacaaattaaaaaaatccaaacaggacacctgaggttccagtcttcagtggaaaaaatatgactagtaattcaataccagtgtacttacaaacacctttatgtatgatttggggcagagggcaggcttagagacatttagcaggcatgggactagatgcagtgktcagcaggccaggtttgggttgaaagacaacaggccatagaaaaagccattagaatgttgatgcagcaacttccagcagtagctgttcacctgggaacaagcagctctgaacttcaagtcaagcattccagtagcccaaaacaaagatctaagcattaatctggcctccctgcaaagactgacaacatataagtaggtgaaagggcacataactcctttgaaactgctaagacagctaaataaatagtctaaatattaaaaaacaaaaggctgacattggcagcaagataaggtcagac

SEQ ID NO: 329 - DNA, 599 bp, Homo sapiens
gttttagaactggtttactcagaagtaatgcactcagaagctgtccatcccacagggccctgggccttccaagggggcacagacaggcttgaggcagggcattgggaattgaaggcaggggctgcaggcagaacagccatacttttagccacttagggtgtatttcatttactagacttaaattatcctactttaatgaaagttctgtggccaaaatgtttagaaaggtttgaaaaacactatattagcccttctgtagactaaagtggtcctaaacacactcacaaattttgtttccastttccctgggaatagaccttttggaacttaaatgctttcctcaggtaatcattgtgtcacatggcaagaaggttcttaagctgacccatgacacagctgacccagaaaaatacactgcatttctactctgaacttggggtatctccttttcacatcaagggcattcttctgagccgcagctgtcacttagctccgtgagaaggaatctcccatgtccactcaggtggcctctaagcatagcacaatcctcccccagttcccccctcccctccccactcccctctccccaggcaacctca

SEQ ID NO: 330 - DNA, 599 bp, Homo sapiens
caggcctggataaagttcttgttgcagaacttgctactgcacaaacttttgttccagggttagatcaggaaggatagtaaggaaaacagagctgtctccaaaaggtgggatagaaagctgtcctttagaagttaaattataaatcaagccaatcagagcaaagatacaaaatgtctccataaagaaaaataagggctgagagaccttactgagtaatgttactcagtaacgccttgctctatctaaaaatgtccatctgaggagaggcggcctgggtaccataatacagagagcctcatygacacaaacagatggtgtccaccaggccccatctagggagaagggctggccaggccagcagggatgagtgaacagtacttcctataggttttgacctgtgttgtggaaagagacatcccacattgcccgagcctgatatcatcaaacatttaagtcagacaattcactcttccgattctgattttaggctcactaagccaccttctgactatggggctccaaactgcatggctacaagaagagaatgtgttcatcaggtggcctcgagtccagtgttcccgacagtcttgcttctaaca

SEQ ID NO: 331 - DNA, 599 bp, Homo sapiens
cagtacttcctataggttttgacctgtgttgtggaaagagacatcccacattgcccgagcctgatatcatcaaacatttaagtcagacaattcactcttccgattctgattttaggctcactaagccaccttctgactatggggctccaaactgcatggctacaagaagagaatgtgttcatcaggtggcctcgagtccagtgttcccgacagtcttgcttctaacaggaatggataagcttcaggttttggggtcagatggccttgattcaaaccctgccactaacatacatagtaacyatgtgaccttgggatttccttcatctttttttctcccaaatgaaaaataaatagattataatataccacatgatagtagggagaaataatgaggtaataatgcatgtaatgcatttagcatagcacttctctagcaaatagtgaatgaaatcagtcagttgtcattctgactttatgcaacagtgctaatcgactctggtacactggaagtcagatgagatttttggccccacaaagtcaaggaccaaacctggaccttgggaagttgccaagatgaaaaacatcaggccggccttgac

SEQ ID NO: 332 - DNA, 599 bp, Homo sapiens
tgcttctaacaggaatggataagcttcaggttttggggtcagatggccttgattcaaaccctgccactaacatacatagtaactatgtgaccttgggatttccttcatctttttttctcccaaatgaaaaataaatagattataatataccacatgatagtagggagaaataatgaggtaataatgcatgtaatgcatttagcatagcacttctctagcaaatagtgaatgaaatcagtcagttgtcattctgactttatgcaacagtgctaatcgactctggtacactggaagtcagaygagatttttggccccacaaagtcaaggaccaaacctggaccttgggaagttgccaagatgaaaaacatcaggccggccttgacctcctgatgctctctgttcacatgtgtgatgtctataaaaggtaaccaggatttggcttatctgcttacatctcttcctgtcttttcctgatcttcatcttcccaaacatagtttttatgcagaagcagatttaactctactttgctatcttggagtcaagaattgtcctataaggaggaagaggctccaaggcttgccttttttgttttttcttt

SEQ ID NO: 333 - DNA, 599 bp, Homo sapiens
gcagaaactgtttgtggcccagcaggtgttggcactgggtgagtgcttctggctcttgtcccacgacgggcatccaggtcttccagcggcctgaggatataggaggggcttcaggcggatgattggggccgttgcttatgttttttccttgtttggcctgcaggtggcagcacaccctgggccccccactccccgccgcaagtcctgaggatggccagcagagaaacaagaaaatggactccctggctgctggagagttgaatgccagccaccagccatgggtgagtggagagcctgacyggagtttttctctaatttgttctgcattatttgtgttttgatatatgaattggtgtaaatcacatgtgttcaattttgaggccatttgttgatttttgcggtttatttacaaaaacaacaaacaatagcagtgaaaccagaattattcctgcaatgtttcagagagtatgagggacaagggcgcatcctctgcattgtaagtgtgacttcccttcccttctgcatcttgggcctgtctcctttgccatccaggtaggaggtatccacccagaatagttcaacaagtgtgtggcaagctg

SEQ ID NO: 334 - DNA, 599 bp, Homo sapiens
tttctgttttgatcacatttgttagctttgtgcttagaataaaataatttcagtttcataaatgggaataagcccttatgtcaagggccactacatcacttcttggcattccagtgaggggtctagtgaagagcttccctgaatttcagtacctttcaaggcctctcttgaaagaatgtggaattaatttgggtggaggcttgtgcatggacttttttctgagtgtatttggccagtgggccaatggggaagcagaggcatggacagagagaggaatgcggcagaaggagaagctggggytgcaggatgccatttgctgtttgtatggcttcccatggcccactgtagtggctagagggcactgccaggaatccttcatgtggctgttgcttgctgttggggaacatgattcagagctgtgtagctccatgtccagttccactctgcatctcactcacaaagctctagcgttgggctgctgggttttggtgaaagcaggtgctatgaatatattgaaggacaaatcagtccctaagggacttcgatagacgcagtcctaaaaacatttccgggctggtttcttttttttaaacaccagt

SEQ ID NO: 335 - DNA, 599 bp, Homo sapiens
cctttgttctgtttggggaatcaaaactgtgttcctccctgtaacaccaaatactagagccccaggggcaggtcccatcatgaatgcccagtagtcagtgccaaaaaaacccaagtcagggaagactatgagacctgcctctggggctctagtaaattcagatgagagaaaagaaggtgggtggtgtttccaggcacacaggtgtgagaaggactagggagcacttaggtccaacttgaacattatttggaggagtgcagagagattgtattggacaggttggttaaccagatttcagtsgtggtgagagtttgactatcaagccaaggagtttgaatttgataccataaggaataggaagtggccgggcgcggtggctcacgcctgtaatcccagcactttgggaggccgaggcgggtggatcacgaggtcaggagatggagaccatcgtggctaacatggtgaaaccccttctctactaaaaatacaaaaaattagccaggcatggtggcgtgtgcctgtagtcccagctactcaggaggctgaggcaggagaatggcgtgaacctgggaggtggagcttgcagtgagccaagattg

SEQ ID NO: 336 - DNA, 599 bp, Homo sapiens
tgtttatacaccctgtcctggcctgagcctcctgaaggctggcacattcagcacagacccctctcactcctacttcccacccaccgcccttctgtgggtcacctgcccactactcaagatagcactcttggcttcttctggaacttctgtcttcaccaccctgtgttcggctctattccaactcatctctaatttctctttaccgagaccaggccgctgacagccctctcaacgattctaggagatttttgttatttcttctctggaaatacaatataaagaatttttatatggttttcyaagtagatatgaagctttttaaattaaaattttgtgttctgataagagaaatgaaccatcttcatcattttaagaagtagaaaatatattatagaaaagcaccaaagaaaataaaaacaacatagaaagtaaaaagtgaaagccctaccaccttcaagaggtgacctctgtcaacagttgatatatctctttccagacttatttatacaaacaaatgtggatctttataaatatacgtatgcacagctttgttcatgaaaatgggagcatgctatatactttgtacagcaactggcttt

SEQ ID NO: 337 - DNA, 599 bp, Homo sapiens
ggtgtggatggacaggtggagtgggccagagcctgagacctttggctactgtctgcggagtttaggcctaattctgtagacttaatttagggcctcaatagatggacatagtgtaatgacctgttctctagggaagtcctactccagggtttataacaccctctacctgaagcttaaagctgtacacacaggcaggtgataagttcatactgagtttggtcctacagagacaagccctgcactgtcccccacagcatacctgccaggggagacacagtttacactgatagactgaagcarttgaagcaaggcactattttaaatgtgcaacatcaggattatttgtagccatgcatgcagtggggatggcaagtggaagaggaatcagtcaatctgaccattcaggcaaaagcagcagttttggtctcaataaagagataattggtctgtttgtttgtttgtttgttttttctcatatcataggtcccttccagattcccaggggcaaggatttataccacatccccagtccatttttgtcactagggaagcacctagatccaggtagtttcctccaagtggtgtctctttggctaaga

SEQ ID NO: 338 - DNA, 599 bp, Homo sapiens
tcttgtctttaactgccctgaagcttcatggaggagttggacaagtacacacacaatgtgctgcatactacaccagaggtatgtctagggtgtggtagtagcagtgtggaggtaaactagttctgccaaaaagaggagactacaaagcatggggcgtggtggaagtagccctccagggctttggactctaatgtttctcaaacagtagagtgttaactgtattaagttgtatttagtccctacaacaaacctgtgagataggtgtcatccatttcacatatgagcagctgaggctcagamaggatcatgcattggcctggcctggtatttatagagcccctgttgaatgctaaggggcgcaaatctaagttccttcctcgtagctcacattccacaggtgaagtcacttgcccaagacgaggctggaatgtcagagcctggattcaaaccctcatctggtggcctcccaccttaccctagaactcactagccctcaggacatcctcttacggggagcatagactgtccctgccagcccctgtggggaatttgaggatttagggaaaaggctgggtcagggataggacaggccctgctac

SEQ ID NO: 339 - DNA, 599 bp, Homo sapiens
gtgctgcatactacaccagaggtatgtctagggtgtggtagtagcagtgtggaggtaaactagttctgccaaaaagaggagactacaaagcatggggcgtggtggaagtagccctccagggctttggactctaatgtttctcaaacagtagagtgttaactgtattaagttgtatttagtccctacaacaaacctgtgagataggtgtcatccatttcacatatgagcagctgaggctcagaaaggatcatgcattggcctggcctggtatttatagagcccctgttgaatgctaagggscgcaaatctaagttccttcctcgtagctcacattccacaggtgaagtcacttgcccaagacgaggctggaatgtcagagcctggattcaaaccctcatctggtggcctcccaccttaccctagaactcactagccctcaggacatcctcttacggggagcatagactgtccctgccagcccctgtggggaatttgaggatttagggaaaaggctgggtcagggataggacaggccctgctactcctatggaaccttctgtttcctgagcattccctggcagcccctccccaaagagaga

SEQ ID NO: 340 - DNA, 599 bp, Homo sapiens
tgacttctgtacttactggagtgatttgagaaggaaaataagcatgtaaatcaagggaagccaggatcactcactctcctggtcccagtcagccctcgtttttgtttaatttgtgtatttcgaagcacacatatctctagggaagaaaatgaaatcaagaactcctcctggccaccggtttcctgaagcatgaaaaggaagcatttcataaatgctttgtaaagaagacaacaggaaggggtagtgtcactggctggcaagagctgctgttgtggtatttcacagacaagggaggtgacrtggcacatgggggctgaggtcccagccagaggccacacaggcacaggcctcagagcccaggcctccctctggcctgtagaccctcagccctactggacaggaggaaaaggcctaggggacattgcccccatttcacagagaggaggctgaagccagtgaagcagagagttgcagcttcagtggggagacactgttatgccccgcctgtcttattcatgcttcttttacctgtagggatttttttttacatggctacccttgagtgatagagccttcatcagcttagcttgtcctcttgc

SEQ ID NO: 341 - DNA, 599 bp, Homo sapiens
tacagtcatttctcctgttttcaaactttatatgatgtaaatggaatcaggcagtatatatcctcttgttgtgtttgtgagatgattcatccaagttgttacttagagctgcagtttattcactcttcttgctatagagtattccactctatggatattcctcgatttatccattctactgtgatgcatttttggatattcgagttgttatttataattcggaactattctgactattgcaatgacatgctagtgtgtatttttggagtacatgtatatccattgctggggaagcatggrtatgagtatgttcagctttagtaccttatgccaaataatgttcccaggtggctgtacccatttacactccctccagcaatgtatgagagttctggttgcttcacatttttgccaaccatagatattttctatctttttcatgttagccattctggcaggtatgtagtggtatcacagtgtggtttgaatttgcatttccctgatgactaatacagctgagcaacctttcatatgtttgttagccatttagatcttctctttgcaaagtgcctgttggaatatttggacatgagtatttt

SEQ ID NO: 342 - DNA, 599 bp, Homo sapiens
aatgacatcgtgtcttgattgcatccccattgcatcatctgggctcatctcatccccacctctggactgtaacatcatcccagggactgccggacactcatctgtgctcccccacagagagtataatgccatttggtaattcagtacagcctcttccaacttgagaaagaagatgcatttccttccctcagtcttgagctgtgcaggtgtcacgctgagctgccctgtgtgggctccatgttggcacacatcggttgcaaggggctctgtgtagtgagtctggagttggaccactggccrggcgctgggatgctagtgcctggactgagtgtgcacagaggcccctcaggcagagccacagtgggcgctgaacctcctggtgaagttcaccgcagtaactagagctcagtgggaggggctggcctatcagcacctgtcctgtgtgctttttgaaaagagcagggtctaccttctgtcaactgaagtcctgccagctgcatggcatgagatgagggacaaagtggcacgtgaacaaagttgacattttggaggctgttaggctcagagccaaccctgggctccatgtagtgccatgactc

SEQ ID NO: 343 - DNA, 599 bp, Homo sapiens
ctgtaacatcatcccagggactgccggacactcatctgtgctcccccacagagagtataatgccatttggtaattcagtacagcctcttccaacttgagaaagaagatgcatttccttccctcagtcttgagctgtgcaggtgtcacgctgagctgccctgtgtgggctccatgttggcacacatcggttgcaaggggctctgtgtagtgagtctggagttggaccactggccaggcgctgggatgctagtgcctggactgagtgtgcacagaggcccctcaggcagagccacagtgggygctgaacctcctggtgaagttcaccgcagtaactagagctcagtgggaggggctggcctatcagcacctgtcctgtgtgctttttgaaaagagcagggtctaccttctgtcaactgaagtcctgccagctgcatggcatgagatgagggacaaagtggcacgtgaacaaagttgacattttggaggctgttaggctcagagccaaccctgggctccatgtagtgccatgactcatggattcaggcccatcttggaaattgctctgggcgtagagctctcatttctgatagtccaagtgc

SEQ ID NO: 344 - DNA, 599 bp, Homo sapiens
ttggaccactggccaggcgctgggatgctagtgcctggactgagtgtgcacagaggcccctcaggcagagccacagtgggcgctgaacctcctggtgaagttcaccgcagtaactagagctcagtgggaggggctggcctatcagcacctgtcctgtgtgctttttgaaaagagcagggtctaccttctgtcaactgaagtcctgccagctgcatggcatgagatgagggacaaagtggcacgtgaacaaagttgacattttggaggctgttaggctcagagccaaccctgggctccatktagtgccatgactcatggattcaggcccatcttggaaattgctctgggcgtagagctctcatttctgatagtccaagtgcagatattggggttcctctaattggcccaaatggtggcctgcaccaaccagcgaccagagtgctgtctgaatctagaataacaggaagaacacgcctccagcagtgtaggagagttccccatgcagtgtgcttcccattcttaccagcagttggtatcttctgtctttttcacactggccatctgagtctcataaggagactcctctccttccactgagc

SEQ ID NO: 345 - DNA, 599 bp, Homo sapiens
ctgtataatgcttcctgccatcctgccttccccgtggagtacagccatgctgtctgctgcttacagccaagattctggaaagaaatgtctcctttttcctcgtcatcaaccactcatttattcagcaagtgtttcttttacacttgcctgtgctgggcatggcagcaatgcagcagtgaacaaaaccatcagccctgctctcatgcagcttataatcaagtagagagacagacataaatgattaatagatgctcctgtaatggtggttgtgaggtgtgctgccacagcccagccacacaygccagttcccttctctgcacatgtacatgtctgctcatccttcccacctgaactcatgtgccacctcacttatgccccttcccaatgccgcacccacacaacagggtgtccctctgtgcccacagcagcccttgggtataactgttccccacagaggctgaaccccaagggcagagtccaggccacactcaccacggagacccctgcctggcacagagcccagcccagcagagatgctcagaagatgaatgaaagtccctgctgagattgatccaatctgtttgtgaacatctctgggg

SEQ ID NO: 346 - DNA, 599 bp, Homo sapiens
ctgctctcatgcagcttataatcaagtagagagacagacataaatgattaatagatgctcctgtaatggtggttgtgaggtgtgctgccacagcccagccacacacgccagttcccttctctgcacatgtacatgtctgctcatccttcccacctgaactcatgtgccacctcacttatgccccttcccaatgccgcacccacacaacagggtgtccctctgtgcccacagcagcccttgggtataactgttccccacagaggctgaaccccaagggcagagtccaggccacactcaccwcggagacccctgcctggcacagagcccagcccagcagagatgctcagaagatgaatgaaagtccctgctgagattgatccaatctgtttgtgaacatctctggggtccaagaattcacggctttctttttctttagagagccttttgtttctttttgccattatatactatatttgggttagggcacaacaatgtgaatatacttaatactgaactctacacttgaaaatggttaagatggtaaagttttaagttatatgtattttgccacaattttttaaaatgcagagcataggtac

SEQ ID NO: 347 - DNA, 599 bp, Homo sapiens
ttattgcaactttgattaatgattgatcaaaaactgatactagaaacactgaagaacaaatttgctgtagacattaggaaaggtctacatctggcaggcctggagacctgcccaccctctccccccacggtcaaaccagggcaaaggtacattggaagacccaacccctacacactcttacacgtgcactcgcacacacacactgaggggaaagaaatatttaattgtccttaaatcctcttggattaggctataaattgcaaataaatggagcaacagacagagcaaaagcacataagktcctttaatagaatttctctatcttattctgtttctatgaatgcctgttacaaattagcagcttaaagggaaacctggagtgtgggaaagagcgacccttgtgtgaagtccacagccggggtttcctacagacctcaggtcccagagaacatctaagatgcctccaacaccagatggaggagggcaggagatgctgcacagagaagcagcacttcccgagcatctgtggcaggaagtgacttggagaggatgaggccgtgcctcaggtgtgctctagctgttctgatggtctctgaggc

SEQ ID NO: 348 - DNA, 599 bp, Homo sapiens
gttctgatggtctctgaggccacgactgccatggtgaggtccacagcctgcatcagaatcaccaaagggcccaaacgtacggcctcagagcctggagagccaggaatcggcattgcaacaactccctgctcagtgggttctaccagtccagtacctgccctctgagggtgcccagggagcagggtgcttgctggctggaacactttttcctgcccctcagctcctctgtgatgccctgaggcacgggcactggaaagctggcagagctgcttctaaattgaaactggaaaatgaaactgkaaatcacagtttcattttccagtttcactcgctccccctactgttggggtttcttttccacaaggagagtcccccagggagaaagaagcaggagtgggagtgggggagcatgttgggggaaggcagtgagggtgtcctgtctgcagcagggcatggaggggccccagcgctgcacttgcttcctttaagcctggcctgcttgctgtcagccccgggggtggtttcctctctaggaaaagctaatgtcatgcttatgctgaaaaactcttttcagaggtactttaggaggggcctggctc

SEQ ID NO: 349 - DNA, 599 bp, Homo sapiens
accatcacacccagccaatttttgtgtttttagtagagacggggtttctccatgttgctcaggctagtctcgaactcccaacctcaggtgatccacccacctcagcctcccaaagtgctgggattacaggcatgagccaccgtgccgggctgacagtggtttttaaagggggagggcagatgaaggacgttggtggaccatcctctgggaggagatgtggactgaggaagcaacgctgacctcaggccccacaccaccctttcacctcagcctcactttctcatcagtaaatggaactcrttcttgtgtatgtgccatggaggcaatgtagcagaagagaatagggcagactttggaactcagccatctgggagaaaatcctagttatgtgatgaccttgagccaatgactgaatttctctgtctcattttctcttctgtaaaatggggacaattacagtgaattctgtgaattcattcatgtccctgacacatggtgtgagctcagtcattacctttgcgagggttgcaaggatgtaatgagatggcagatgtgagcacagctcccagacccgaaggtgctgtatgaatgggagggag

SEQ ID NO: 350 - DNA, 599 bp, Homo sapiens
ttgttttttgttttttttttgagatggagtctcgctttgtcacccaggctggagtgcagtggcgcgatctcagctcactgcaagctctgcctcccgggttcacgccattctcttgcctcagcctcctgagtagctgggactacaggcgcctgccaccacgcctggctaattttttgtatttttaatagagatgggatttcaccgtgttagccaggatggtttcaatctcccaacctcatgatccaccggcctcggcctcccaaagtgctgggattacaggtgtgagccaccgcgcccagygactagtctttaaaaaaatgaataatataaatttttttaaaagatgaaaacatatatataccctgtaacccaagagtcccactcctcagactcttctcaaaccacactcttacccatgtgcaccagaatacccacacagcaccagaaaatgtccaaatgaccatcaaaagtggagagtacaaataaattgtgcagtgttcctggagtgaaatgaactacagcgacttgcaataactgtaatattgtcatattggataataatactgtaataacaaatgactcatcaatgaataaaacct

SEQ ID NO: 351 - DNA, 599 bp, Homo sapiens
tgtgttgttttaagcccctaagtttatgttagtttattagagcagcaacaggaagctgatccactgggaaaccatctgggatatgcagctgcccaaaatccctgctcgtggttagattcagccttacgaggctccacagcccctctgcgaaagactccattccctcttggagaagctcagactctagagccctgggcaaggaatgggccttcatggcatgggggcgatcaagaaggatgccccccaggacagtgactctgctggacttctctacagaaaacagtatatccctcagtggcrtgagaagatccaatagggtcaccacactccacaactgcaggggacactgttcacattttagtctatgcagcctctggtggccaaagattaaatgagaacacctttgctgtgtgacctgaagttcatggtcagtaaattgtagctattgttatgcacgacttagggggaagcaggggtcactgcagagcagcagtggttttatagagatttgctttatgattatttgttaaactgaacatatattctatgtatttttctgcataattattgtttcacaatttttaaaaagcatatacaca

SEQ ID NO: 352 - DNA, 599 bp, Homo sapiens
ctcagactctagagccctgggcaaggaatgggccttcatggcatgggggcgatcaagaaggatgccccccaggacagtgactctgctggacttctctacagaaaacagtatatccctcagtggcatgagaagatccaatagggtcaccacactccacaactgcaggggacactgttcacattttagtctatgcagcctctggtggccaaagattaaatgagaacacctttgctgtgtgacctgaagttcatggtcagtaaattgtagctattgttatgcacgacttagggggaagcaggkgtcactgcagagcagcagtggttttatagagatttgctttatgattatttgttaaactgaacatatattctatgtatttttctgcataattattgtttcacaatttttaaaaagcatatacacacatgaatcttctctagccccgaacagcacagtgaatggatagggcagcagatgagctctgccccacgccggccctgtttcagaacagcactccagagtgccgcactgcttgctgaaccacagctgttactgcagattgaggagcctcagagggaacagaagataaagatcattat

SEQ ID NO: 353 - DNA, 599 bp, Homo sapiens
caccacactccacaactgcaggggacactgttcacattttagtctatgcagcctctggtggccaaagattaaatgagaacacctttgctgtgtgacctgaagttcatggtcagtaaattgtagctattgttatgcacgacttagggggaagcaggggtcactgcagagcagcagtggttttatagagatttgctttatgattatttgttaaactgaacatatattctatgtatttttctgcataattattgtttcacaatttttaaaaagcatatacacacatgaatcttctctagcccygaacagcacagtgaatggatagggcagcagatgagctctgccccacgccggccctgtttcagaacagcactccagagtgccgcactgcttgctgaaccacagctgttactgcagattgaggagcctcagagggaacagaagataaagatcattatggaatttaggattgcaggacattctttgacatttcataacagccaggggagatcaactgtggtcaggggacaggggcaggaagaaaccatggccaaggcctgtctggcaggacttgaaggggcagagggacccttgcaaatgac

SEQ ID NO: 354 - DNA, 599 bp, Homo sapiens
agaagctgagacaggagcctagaggatggacagtaaggagtcgaaggctcaggatgaggctttcctgactttctcccctagaggactgatgttctctactggtacagaccttgttttattcatccttatgtccctaacctggaatgggcccagggtgacagttataataagtgtttgtcaagtgagcaagtgtgtggagtgtgcattgtagagagtaaggtctctacaggatcctgctggagaggcagcccactgggctcaccacttctccagaggagggactggtcccttgccagacarccctgccagctggagcaggcttcctcaggggtgcctggagctgttgaccatggctgttgccctctggcccctcttgggaagagcaacctgtcaggtgttaaagacggtcttcatttctcttctccaagtaaacatgactagtttccatctcaccatcttctggccctcagcagactggttatccagtctggagaggcaacagtagtatccagatgtgatccgaacagacagaacgatggatgcagacggaaaattcaggtttgtgtgcttcggcagtcagtatatgcaagtcgtaatgg

SEQ ID NO: 355 - DNA, 599 bp, Homo sapiens
ctggacttggagggaactgactagggatcacctcccagctctgccatggacccactgtgtgaccatgggcaagttacttgacctctctgagcctcagttatcttatcagtgaaactgggttaataatatatctctcagtggcacaggaggatcacatagggtcaccacactccacaactccaggagatgctgttaacattttagtctatggatcctctggtggcctaagatttaaatgagagcacttttgctatgtgacctgaagttaatgtcaataagttatagctattgttatgtacratgtaagcaggggtcactgcaggccagaaggctgacacaatttggccaggctttgttcttcaaggaagggcagggctctgagaagtgcagaccgtgatgcaggtgaaggccaggaggcagggactcccagggcaggtctggaaggagcgaggctggtgacggaagtggtcagcaacctcaaggcatgagtaaggcgcttgcccttctctccaggcacagaggagtcactggaagctgggcaaagagctgggatggatgagaccaaggcgaatactttacttattaagctgcaaaggacc

SEQ ID NO: 356 - DNA, 599 bp, Homo sapiens
tcttcatttaagaacccttgtgattacactgggcccacaccaataatccagggtaatctctctatttgcaagtgagctggttagcaaccttaattccatctgcagttttaattcctctttgccatgtagcaacatattcataggctcatgcattaggacgtggacctctttattccactgtggaccaatactctgccttccacacctagcctctcttctgagttttccaagggccccccatcctcaggcatcctcaggcatagacagccggctgggccagaccacagtcaggatgttccygccactatcagagaggtcctttctacctaagtcccctcccacctgcctgctcctctttcagctcggtctgtcctggattcctcttccttcatcctctgctcccagtcttaggtagagaagagctgagcaggaagtgccagggggtgtggagatggaggagggggaaggtaaggcctgaggcaccagggctctgggagcccagggagctgaggcctttcaatccagacaccctgcacttctctggctctggggcctctggggaccacacactcagctccagggctggaggggtggccagc

SEQ ID NO: 357 - DNA, 599 bp, Homo sapiens
gtaggaaggggtcagataaggtgggcatttggggcctctgatcaggggcttgggccttatgcacagggtgaaatgggccagtgtgcattttacttatttttaaacttttaagttttctgtttttcatttttttagatggaaaaatgttgtccaggctggtctcgaactcttgagctcaagcatttatcctgcctcagcctcctgagtagttgggattacaggtgctcatcactgtgcctggctcagtgtgcattttagaaagctcactggctgctgtttgcagactgggctgcagtgggrcaagtgtggaaataaggagaccactggggagactggagtaggagggatgaactagagtggtggtggtggcaatgatgagaatggggaatgaacccaggcagagtatagaggggaggacacacagagatgaataaaatgtggtggctccgaatgggagaaaatatttgcaaaacatatatctagtaaagggtatgtatctagcatatgtaaagaatgcttacaactcaataaggcaatgcatttttgtttgtttgtttgtttgtttgttttttgagacagagtctcactctgtagcccaa

SEQ ID NO: 358 - DNA, 599 bp, Homo sapiens
ctcaagctgaccactggagggtgcacacacaggacagatctaaacagcactataaaggctttgaaaatggaacaaacattgaaactacaatccacagaaggctggtcggaacttgtggcccaaatgcagctgcattgattgcctgctaaaatataaacattaacactctccacaatgttcaaataatacccagagtctcataaaatttaaaatgtccaggatacaaaaccaaagtatgatcttcctggcctatgataggaaaaatctcattttgcatgggaaaagacaatcaaaagagamcaatgatgagatgttggaattaagtaacaaagactttaaagtactactatgaaaatgctccaagtaaaccctcttggaatgaatggaagatggacagtctcagcaaagaaataggagatataaagaatagggaagtaaaagttttggaacttaaaaatataagggccaggcatagtagttcatgctataatcccaacactttgagaggccaaggcaggaggataacttgagcccaagagttcgaagctagcctgggccacaaagtgagaccccgtctctaaaaaaaataataagttagg

SEQ ID NO: 359 - DNA, 599 bp, Homo sapiens
ttccctattttttgtttgcaggtggcgggggctccctggacctgggattcccacgttcttcctcctaacttgctgcctcgtggccctagacccctcttgtgtaacacagacatcagtcaggctctctcaggctcctaagacctggacgacaggctcaagctcctatttgctcacgtgcaagtggaaagcttttgccagggtgtttgcaagttcccttgtgcatgactgtgcatgactagcactgactctctcctgatacagcatggttagatctgtgtgtggctcatcaggacattcaamaagtaatgcccctgttctgcaccccacagaaggcagtcctttccactgagtcccattcacacagccaagctgaccatcacccggatctgcctgtggcagaagcaacttcaaagtgagcgctagtgctcctattcttgaagtcctgtggtcacgctacagtgatagaacttcttcttcttcaccccctttccattctgtctgcagctttgtgccatcttgccagttccccctctctcttcacccaattgcagtttatttctaatacacagagcaatttctgtagcccttttgtaacaatt

SEQ ID NO: 360 - DNA, 599 bp, Homo sapiens
tttttaaaagatctctagcttttgtgtgggcacagattaggttgtaatgttcgaccagagaaacaagttaggatgctattgctccatggtgagtgacatggttatacagggtgaatggtgcagggtgggctggaggagaagacagaatcctacagtgcagggcattgtagtgggcatctgatctctctcttctcccacctctatgcagctgcttctctctcctcagaatccagacccaaattttaccttctgctgggaaagccttccttccctattttttgtttgcaggtggcgggggcyccctggacctgggattcccacgttcttcctcctaacttgctgcctcgtggccctagacccctcttgtgtaacacagacatcagtcaggctctctcaggctcctaagacctggacgacaggctcaagctcctatttgctcacgtgcaagtggaaagcttttgccagggtgtttgcaagttcccttgtgcatgactgtgcatgactagcactgactctctcctgatacagcatggttagatctgtgtgtggctcatcaggacattcaaaaagtaatgcccctgttctgcaccccacagaag

SEQ ID NO: 361 - DNA, 599 bp, Homo sapiens
ggaaactgccacactggcaccccctattcctccacagtcatccctcacttgtctgttcatttggttgtttattcattcactcagcaaatactcacacagctgcaatgtgccaggcactgttctaagtattggtggcacagcagggagcaggacatagccctgctctagcagcatcatacacatttaggagggtcagacaacaaacaaataaaacaactataaattgtggtaagtgccttcagtgcaagtagtagaagcaaaacaacccagtgttaagatgctaaagtcaggctacctggktttaagttctgcttctactgctacctgccattgggcaagttaattaatctttctaggagtcagttttcctttctatagattggaagtgatcatcaaacctactgaataggattgattgaagatttattctttccaaaaatatttattgagcaccactatgtgccaggcaccatgccaggcactaaggattaatagtgaaggtgacagacaaggttctgccctccaggaacatacatgatagcagaggaagagtcactggacaagcaaaggccatgtcggatgtgataagggctagggac

SEQ ID NO: 362 - DNA, 599 bp, Homo sapiens
cttaaggtcccagctcttgccaattggccgtctgcatgtagtgctctgtatcgctgtagtgctctgtatctctgtgtgctctgtatctctgagtttcagtaaatagtccctctcctgttgcagttcctgttaccagtcgccaagggctttgttttccctacactctattcttttataatggtccctttattaaataaactgccttaagttactcaatatgagtgtccctactgtttcctgctggataagcccactcccaggtcatattttctgtttttaaattagtttttcaccggtctrtctgtctacccctaggatttctcaaccctgccactactgacattttggatgggagaattctgctgtggagggctgttgtgtgtactgtaggatgtttagcagcatccgtgacctctacccagtagatgccagtagcatcccctccttcccctccaattctgacaaccccaaattgccaaatgttcccttggggttggggaatcaccctctgttgggaactactgttataaccccttgtcaaaaccacacttaattattaaggcttgatatctagcaagacaagttctcccatttgggtt

SEQ ID NO: 363 - DNA, 599 bp, Homo sapiens
ggcagggaagtgtaaggtgtgcaggagtttactaatatgtactgtcagaatccagaatcgagtgcatcctgcagctgtttgtccagaagaatatagagttgaatgggattggatttattggtgtgggtatacttacgactcagaattaagttttcgcaagaacaactggagttagtcctaatagtttgctggagtggctccttgaagcctgatcctgatgatggtgtacagaatatgaagtggagacacctgaacttcctcccatagtattgaagaaaagagcagatagctcagagaagyaggaatactaaaatggattttttgtatctggcctgagaacctactatctgagtatgttcctggaggacacagaatatactccttttactaacacagcaacagatacactagtgaagagaagcaggcatcattgcaaacattggtggtggatgtcccctgtaagctgggttgaaggtgaaagatgctgccaatgacatggactccctaatatcaataggcaacatgagatccctagaatggcagagctcaggttggaagcacttaaacattagaggcaagggggacataattaccaccac

SEQ ID NO: 364 - DNA, 599 bp, Homo sapiens
tttcaccatcttggccaggctggtctcaaactcctgacctcgtgatccgcccgcctcggcctcccaaagtgctgggattacaggcatgagccaccgtgcccggcctcaaggagtcttttacctgcagctaggagcctaaagtaacaaacaacaggagttctttggcagaactcctgggcaaaagagagcaaagctttaaagttcagctacagagacggaggcaatgtgaactaccatttagattttttaaaatccacgttattttagggaaatagaaagaaataaacaattagtactttsatttttaaataattactggttggtaattttataatttaaaaaaagcactttgattaatattgaaaagttacattggtgggtaacatccatccttttgccctaaaacttttatctctattagtgggtaacacattggcaacatgtctttaaaactgataactgtggtttttactgtgtagtccttaaggtcaaatgacttttccatgaactgattctaatcaactgagcatgatgcctcgcaattttcatgatgactaaatgtaaattgataacatctctttttcttcttgactctattc

SEQ ID NO: 365 - DNA, 599 bp, Homo sapiens
gcttcagcccaggagttcaaggctagcctggacaatatagtgagacccactgtctagaaaaaaaagtatcatgataaaaatctttgtgtatgaatcattgtttgaattatggtgtttatactattcgtatgtgtaaaggacatagaatttggtctataggtttgtttttgcacatatagaagtgaaacaacaatacacacacacacacacacacacacacatatatatatagtttattcgtttttagtggggtcatgtgcctctctagccgctccctgaccccagttccactatgttttygttacgtattcttccaagcttttttctgcttataaaaccatgtctacgtgagcacataaatgcattcacacatacatattttagcacattaatataattttatacttctattttattgtttttaattagtaaattgtattccattgagtttatatcctgtagtttattaaatgaccccctgttgattattatttgtttctaccttagtgtgattaaagataactctgtaattatgaaaatatttatgaattttcctcttagaaatgtaatagtatttagtacatttactgagtcctctc

SEQ ID NO: 366 - DNA, 599 bp, Homo sapiens
ccacaaataggggggatccagctcagaagcagagtgtccacgccagggaatagtgtggggattcagagcctgataatgatgagaagggggcccacctgagggttaagtcggctagggggaagtcagatcatagagtagagacggcattcttgcaagaagccacctggtataaagtatcagactgagaagagtgaccctctcagtgacacagatctggggagattcaggtcagagtacagtgggcatccctgcaagaggccacctggtatcagagaagggcggggaatgaggacatgatcyagcaccagaagtcaaagtgtatacagaatggaaaagcatcccatgagggagtcagaatgaagagtcaagagcctacgcaggataaggaagactggcatacagggatggagtcagcccatatgaggtgctagggccctgatgcaacgatgagacattgattacatacaggaggattgattaagtcaatatattaagattatggttgtataagtacattcttgcactgctataaaaaaaaaacctgaaactgggtaacttataatgaaaggaggtttaattggctcacagttccacatgct

SEQ ID NO: 367 - DNA, 599 bp, Homo sapiens
atacttcagaacaatttctatcaaaaagaataaaataaaaaataagaaaaacccttctttctccaaacaatctagttgtaaaaccattaggtggggcagaagaaggtgcgtgttcatgccagctgaaggttaaggcacctataactcagcctagagtggaataaatgagcttgagtaggctgagaagggtaccctcatggggaaacagcttggcatagacagagtttcaagagtccaatggtatcagagttccagcaggatgaaagaggaatccacaaataggggggatccagctcagamgcagagtgtccacgccagggaatagtgtggggattcagagcctgataatgatgagaagggggcccacctgagggttaagtcggctagggggaagtcagatcatagagtagagacggcattcttgcaagaagccacctggtataaagtatcagactgagaagagtgaccctctcagtgacacagatctggggagattcaggtcagagtacagtgggcatccctgcaagaggccacctggtatcagagaagggcggggaatgaggacatgatctagcaccagaagtcaaagtgtatacaga

SEQ ID NO: 368 - DNA, 599 bp, Homo sapiens
atccaaaatgaaagaaataatagaattagtagataagaaccctaaaaccttattataactcttataaatatgctcatagatataaaggaaaacataagcataatgagaaaaatggaaaataattttaaaaacccaaataaacggaataatggtgttttgtatataatggtacaaataggttaaaagcaaaaggattgaaaaaatatactgtgccagctaatgaaaagaaagctgaagtgaccatattaataccagacagaagacatcagaactagggaaaatgaaacattttatgatgakaagaggtcaatttaatgcaaggacacaaaaattctaaatgtaaaacttccaaatatatgaggcagaaacctatggaacagaatggagaaatacacaaatctgcaaggtcaattggagatctcaatacccctctcagtagagaaaagaagcagatgaaatatcagtaagtatatggaaaattttaacaacactgttaaccaaatcaacctgattgacatttataggacattccattgaacgatagcagaatacactttattttcaagtgcatgtggaacattctgtaagatagaccaaca

SEQ ID NO: 369 - DNA, 599 bp, Homo sapiens
atccggaaaatccccaaataattgaaaaattaagcagcatacttctaaatattacatggatcaaaaaaggaatcacaagggaaattagaaaaaatactttaaatgaatcaaaaatatagcatgtaaaaatatgtggggtgcagctagataatgcttagagagatacggtagaaaagaaaccaatcagtataatttgccacattaacagaataaaaaagaaatatcatatgaacaccaatagatacagaaaacgcatttcaatttaatagtctttcgtggtaaaaaccctcagcataactratggaggaatattaattcctgaataattcagtccaaaatccgttaggtgtggctgagtgaggaaggcatccacaaaaacaagctgtgacagcctggtgggggattggagcccaagtaaggaatctatgagtttatactgatacaagaaaatggggggggaaatggagaaagagcaaagccccttatactagaaccttaactaatataaaaggaataatggaactagaaaattactataggcataccttagatattgcaggttaagttctaatggatggcggtcttgtctacattgaaaa

SEQ ID NO: 370 - DNA, 599 bp, Homo sapiens
aattatggtatatattcatacagtgggatattatgctgtcactaagattacagttacaatgagtttttaataacttgtaaaatgcctatgacataatggtaagtgaaaaaaattacatttatactgtcaatcaggtaaataaatatacgcacagaaagacaagtgaaagaaaatatgcccaatggttgctgctggatgagaggtagtaactgatgacctttctgctttttaaattttttctgttaaaaagaagcatccaaattgcaaacacagttcaataacttaatggactacaaagtytatttaagggttacaaaccttgttgctgaaaaaatctcatcaaacttttgcttcaaagcctttccttcacttaaaggccaattagaatcttcttgatgacagaaaatgacattatttagcacagccttggaaaccccaagagaactgatcatttctcggtcaatttctgcacacttagagctcagactgaccttttcaccatgcctacagaaaatgaaaatcaagaatatatgtaaaataaccttcagtgtatctattctattgcttaatcaattcatactgtacttctttaaaagaat

SEQ ID NO: 371 - DNA, 599 bp, Homo sapiens
tcttttactttctgaccttgtgtctgacgtacctgccgaagtgtttctaaggctttaatgtatctttgaagatatgaaacaaaaatcaaatttctggcaaagtaaattatggtatatattcatacagtgggatattatgctgtcactaagattacagttacaatgagtttttaataacttgtaaaatgcctatgacataatggtaagtgaaaaaaattacatttatactgtcaatcaggtaaataaatatacgcacagaaagacaagtgaaagaaaatatgcccaatggttgctgctggrtgagaggtagtaactgatgacctttctgctttttaaattttttctgttaaaaagaagcatccaaattgcaaacacagttcaataacttaatggactacaaagtctatttaagggttacaaaccttgttgctgaaaaaatctcatcaaacttttgcttcaaagcctttccttcacttaaaggccaattagaatcttcttgatgacagaaaatgacattatttagcacagccttggaaaccccaagagaactgatcatttctcggtcaatttctgcacacttagagctcagactgaccttt

SEQ ID NO: 372 - DNA, 599 bp, Homo sapiens
ttaccattacatgtgcttgtcatctctccaaccaagatgctcctcaagaaaataaaacgtggagtggggcaagggggaaagaagaaaaaaaaaggaaatctgttctaatatcttggtaattaccacgggacccacacagagttatcaggacaactcatcctaaaatataacatagtcttccactcttctgtctattgaactaagtctgaaatccattagctttctataatctgaccccgattcatattggtcatttactccttttatattgatttacttaacccagactcttcctctcayaatcctgttctgattaagcttgtaaaggtaaatatgcacatacatacaagtgaatgtttgtatatacatatgtattgtatatatgcagttaaaaaaagttgcaggtaaaatatactctggaaggttagagatgagaaatggaagactatcttttacttttcacctaatatccttttataacttttttactaggggcacatattacttttaaaagaaaagtcaaaataaatacaaacatttccaggtgcggtggctcacgcctgtaatccctgcactttgggaggccgaggcgggcagat

SEQ ID NO: 373 - DNA, 599 bp, Homo sapiens
agtgctcagtttctttccatcagtgttttcactgcctcttggtagcacaaacattatgataatcatctgggcttggatctttcatgacatctctacctgcttcattccttaaatccagccagtcaccagatcccctgaattccttctttgacatctgtgttttggttctaatctcagagcacaaaacataggttctatccccagagtacacacctagtaaaaggagctaggacaagcaggcagacaacaataacaaaaacagccaagggtttaaagcttaggtgccagtgtgaaatgagmtaaaaaaaatagagcagctgggctatcaagtatagaaggaccatgaacttgtgtgcagaaaaaaaaagttagaaacatattcctctagcaattcccatttaaggcaagaaaggaaaacagatctaagtaggccaaaaaaagaggacaggatatggtgggatggtaataaagtagtttatgagagagtgagagttcccgaagataaagggaatcagtaaaaatgggaaaggatgcattctagtgcatggttgaaaggacgtagtcttttctgggaaggtgatttgacccaaactttaatt

SEQ ID NO: 374 - DNA, 599 bp, Homo sapiens
tttggagatgtaatagaaatctcttatttcatgcttacctgtttaattgttttaaaataatttattgtcatgaaatggtatgttatattgataaactttagttcttacatacaaggagacttcagaaagttcatggaaaaatggaattaaaagataaaaattttaaataaactgtatttctcaacataagctccatcaagttcaagactcttctgagcagtgataccagcaatttagttcagtcctaaagaactgagggtcctgggaatttaaccatgtcagtgtagtcttttttacatygctagcataaaaatgggtgccctttaaagatttttttaagattaagaaactagaagacaggaggagccaaatcaggactgtaaggtggatgcctaatgatttcccatcgaaactcttgcaaatggcccttgtttgatgagaggaatgagcaggaacattgttgtggtggaaaaggactctctggtgaagctttcctgggcatttttctgctaatgctttggctagctttctcagaacactctcataataagcagttgttacctttcttcggccctccagaaagtcagcaagcaaaatgc

SEQ ID NO: 375 - DNA, 599 bp, Homo sapiens
gtatgtatatgtactactttgagaaatttgtttcagataaatgtgtgtgactgcacacatgcttcttcatcatgactacccatcctgagtcacagtaaacatttggaaaaaagtaactaatatgatgatattttcattatcctagactcccttgagcacttctcatcaagatcaccagtgacctaagtgccaagtacagtcttcatcttactctacctctacgtagcaccaaacactgttgaccttctccttgaagactattttcccaaggcacctagacaccacagctatctggctctmaccctggttccctgggcacatcccagtttccttcacttgctccttttcctttgcctgctaacattttaaatgtttgtgcttcccaggaatctaattgtaactccttccctttgcataactctctcaaggtgacatactaatgactttgagtatcccttacatagcaacaacttccaatctcctgaatttcaaactccaatattgtattccctcacagatacttccacaagaaacacagattaaacaccaccaaagccaagtccttctactttcctcaaaaatctgtgtggaatttttga

SEQ ID NO: 376 - DNA, 599 bp, Homo sapiens
gtgcttaaaaaatgattcaaacagatgtgttaggtaagaagggaggagccaatggatacagaatgagaagaatattttgagaatgaggcaggaagaggaatataagacctggagaagttcattcagctcaactgagaggagacggaagtcagaacacggtgcaaagggaagaggagtatgacctatgctgcagtagaaatgttatctggagtttggggaattatttatagggattgagtcctgtatgttggggagatagggctacattatattcaggtctagttgtaactctgataggtratgaggagccaacctaagggagttagtgaaagatgtattttaggaaaattaatctaatattaatatattgactgaaacaggctgagaaaagctcaggaagcagaaaaaccaggagagtgaaagtgattgtcctggaaaaccaaggaggagtttcaggaaaaggagaaagaaaggcctaagaagatgtggtttgtggcagccaacttctaagatggtccctagtaatctcggcctcttggtatttatactcttgtatagtcccatctcatgctgttgcatgattggtctatataactgat

SEQ ID NO: 377 - DNA, 599 bp, Homo sapiens
acattatattcaggtctagttgtaactctgataggtgatgaggagccaacctaagggagttagtgaaagatgtattttaggaaaattaatctaatattaatatattgactgaaacaggctgagaaaagctcaggaagcagaaaaaccaggagagtgaaagtgattgtcctggaaaaccaaggaggagtttcaggaaaaggagaaagaaaggcctaagaagatgtggtttgtggcagccaacttctaagatggtccctagtaatctcggcctcttggtatttatactcttgtatagtcccmtctcatgctgttgcatgattggtctatataactgataaaacaggcagaagtgatagcatggcctttccaacattaggttatttaaggtactatggcttcttctgttctcgcaatgtgcttgtacccttgtgtgaactcgctcactctcccccactcctcccctctctcactcactctgtctccctctgtctcttgtctgagggaagctagctgccatgttgcaagcagccctctggagaggcccatatgccaaggacctgaggcctttgagcaagtgagtttggaagcagactttgtag

SEQ ID NO: 378 - DNA, 599 bp, Homo sapiens
ataacattataaaacactttttttaagtttaaataaatccacaaatgaaaggtcaataatgaattaagaggacttgattgattgatagatagggtcttgctcctgtcacccaggctggagtgtagtggtgtgattgattatagctcatcgaagcctcgaactcctaagctcaagcaatcctcctacctcagcctcccaaagtgctaggattacaggcataagccaccatgcccaaccaagaggactttttttttttttaaatatgggaaagcaattgcctaagagtgcagtcaggttgayttcaaattccaactctgctgggtgaccttagggatgttacttaacccatttgggccttcgtatcccccacgtaaagtgaggggattgatttacatgatcattaagcttccttccacctctggttaggatactactttcaaatatcccgtggggtcactttcagagacattgtggaggtctatttatgatagtcacttaggtggaaggttattggtgaagaggggtaaagtaacaagattaaatttatctgtgcaccatttgctttttcacctttagaatatgcccttgatgccaccact

SEQ ID NO: 379 - DNA, 599 bp, Homo sapiens
agaccatatcgaatttagcagtttttccatcaatgccttttctgtttcagggttccatgcaggatcccacgtagcatctagttgttatttctccttaggctcctgcagtctgtaacaatctgtctttatctttcatgaccttaacacttttggtcaatatgaccagttcattagtagaatatttctcagtttgacaaacaccacagtaataattattgcaagcaagatctgtcagtggatactaaaatcagtaggcagaaagttgagaagcaagatatttacatagtctcaacatttctytcctaagatacttgttaattacaaagactaaaacagtaactttacagtggagaaacctggccaacaccatctaagccaagtgaataaggattaacatcatcagtaataagacatattgatatcatgattccatatccactgatatgataccctgaaaagaacacaatgtcacttctgtggtattcttcctaaaaatacataacctcagtctaactgtgagaaacatcagatactttatttttaattgtgttttctatttaggcaaagcataattgatttgaaggagaaggaaataccag

SEQ ID NO: 380 - DNA, 599 bp, Homo sapiens
tcttaagatggaacttaaagatgttgaaagaaaaattgcacaacaagcagctaagctacaaggaatagacttagatcgaactgtccaacaagtcaaccaggagaaacaagagaaacagcacaagttagacacaggtaatacagtctgtgtccttctgtactcatagagactttgacattgcgagcacatgccttttacagtcaattttatatctgttacatggacaacgaagttccttcctgtccacatatatttgctctttttttctgaaaagcatcacttctctttgttctcttactktgcacaacagattttgaacagtaggagagtatgaaataagctgtattctcttttccttttttttttttttaagatagagtttcacttttgtcgcccaggctggagtgcaatggtgcaatcttggctcactgcaacctccgcctcccgggttcaagtgattctcctgcctcaccctcctgagtagctggggttacaggcacacatcactatgcccagctaatttttgtattttttcgtagagatggggtttcactgtgtttgtcaggctgatctcgaactcctgacctcaggtgatccac

SEQ ID NO: 381 - DNA, 599 bp, Homo sapiens
ttttaccatcatgttttcatctgaaaaagaaaagtctggactgaatgagctttcctattctttgatcatgcagcagtgacgggcacctataaaatcatgaaaactcatgcttgaagccacacgctaatataattgggagcacatggcctagattaagaatcaaattagtggttgatgcagtatagcatgcgtagtggttaagagcgtgaactctggagctggactgggttaaaatcttggctgcttcatttactggctgttgtgaccctggacaaatcattctctgtgtctgtttgctcrtttgaaatataggactgaaaatgatggtactgtcctcatagggtcattgaaaggagcaaatgagttgacttttagagcctggcacatagaaagtgcttttattaagactgtgaagtctgacccctaaagtaagataatggaatattatataatactttatcttttttatatttttaggatgctaaagagcaggtaagccctttggaaacaacattggaaaagttccagcaagaaaaagaagaattaatcaacaaaaaaaatacaagcaacaaaatagcacaggataaagtaagatttca

SEQ ID NO: 382 - DNA, 599 bp, Homo sapiens
ttgtactgtaagcagtgagaattccaattatagtctacaaaatgtatcagagaaaggaagggaaaaaaaatcagatgcagttatagtataccacaaatgtttttccattctactagaaatttgatagtgtagggtccagttctacctgttactactttttgtgaccttggacaagtcaggtcacctacagttctcttcatatattccttcagctgaaaactgagaaaggcagttaagtttccaaattattttattctgtggactaaatttagcagggcttaaatcagtacgtaaataagygactgttaggctcctcagctcttaaatattaaccccaatcatccaactcagatgacagttaatgcatgcagctggtcacctatggaaacataaaaattagctgcattctagatacctgtgagagagtggcatgctgaacagattacagtccaatgtccaccaaaagtctagctgggaataacaccacttctacaagactgcctgaaagctatgcagtccatccagtgctggctcagttattgacagctaaagggatatattagaacctctaaggaatttcaacaaaacacacatatctc

SEQ ID NO: 383 - DNA, 599 bp, Homo sapiens
acaagaaaggtggctacaagataaccttactttaagaaaaagaaatgaggaactaaaagaagttgaagaagaaagaaaacaacatttgaaggaaatgggtcaaatgcaggttttgcaaatgaaaaggtatgcttttaaaataatcttcagtttaaataaacgtctttattactggaatgtgaagaatattaaatacctgttttaaaagaattttagcctcagcctggtatcctttgagagttactagaaggtgaacagtgttttgatacaattatatttcatggccttaagaactttatyactgaagaagtgatatagaattggtaatcacactgtagtgatgggccttagttattcagtattgaacatgcttagcccccatacatctgctagcctgctgcacagaatagtggtactaagcataaagaatatggagctgtggaccttgtctgggtcagagcttgtacagtctataatattgtcaatggagttgttgccagagtgatttatccacagagattcattttagattttctcatttgtaattatgtgtccaccagagcatttcttttgaaagatgagcctcattcttcctttat

SEQ ID NO: 384 - DNA, 599 bp, Homo sapiens
gtatcctttgagagttactagaaggtgaacagtgttttgatacaattatatttcatggccttaagaactttattactgaagaagtgatatagaattggtaatcacactgtagtgatgggccttagttattcagtattgaacatgcttagcccccatacatctgctagcctgctgcacagaatagtggtactaagcataaagaatatggagctgtggaccttgtctgggtcagagcttgtacagtctataatattgtcaatggagttgttgccagagtgatttatccacagagattcattytagattttctcatttgtaattatgtgtccaccagagcatttcttttgaaagatgagcctcattcttcctttatctggtcttattgttacttattgtagttgctaccttcctggtacagcagaaaagattttattcctgccttgactgccttagagttagttgccttaggaattctgtaagaaccttgttgatgctaaggcactagactggtataaaaggttgtactaggcaaatacttagattgtcaaccacctcagctggttaaatccaggcctctcatttattaaacccttccttgt

SEQ ID NO: 385 - DNA, 599 bp, Homo sapiens
cagaaaaatcacagaggaaattatgatgaaagccaagaatgtgaccctaatatcctagttcccaagcctcagttcttttacacgatactctccatggcaagttggaaaagtaatgcttctagaagaaattttgatataaaataatatattcgtggctactaaagaccaaaaccagatatttaaaaaatttcttctgtaattggtacataacagtactttttacattcattcacattactaagtacaactatttttcaaacgtttcttcaaccaggacataacagaaatgccaacaagacwtgtaatccagtcgactctgtaaggatgcccataagcttgagagtagtgcctgacacataagaggatgcttaataagtgataataaataaatgaagatttttaaagcatacattgaaatttgtataatctgccaaaatatcagaaaagtttgaatattttacttttttggtcattattatggtttttacacttgtgcaagagaaattttgttttcatggaggaatctaaatttttaataagtattactgcagaaaattaatatatgatttaattcgtattgtgcctttgacatgagcaaa

SEQ ID NO: 386 - DNA, 599 bp, Homo sapiens
aggatgcttaataagtgataataaataaatgaagatttttaaagcatacattgaaatttgtataatctgccaaaatatcagaaaagtttgaatattttacttttttggtcattattatggtttttacacttgtgcaagagaaattttgttttcatggaggaatctaaatttttaataagtattactgcagaaaattaatatatgatttaattcgtattgtgcctttgacatgagcaaaatgatgatgaagcctgttatccataacttcttagtgttgataattgtgcattctcagttcayaatcagaagattgtgaatttgtaatattaatcaccagagtgctttacttagcgtctaaaggccaggaactttatcagtgatcacatgctatgagggttctgtaatacacaaaattagctatttagcaacctatgtgcggcagagatatggaaggaagagaggggttttctttagtaccaaagccctaaataataagcaaggagagactctgttataatatactgattgctaaggagaatgatacttaacctatctaaagaaatctatgacttttccacttcaggttgttaaaagctaaa

SEQ ID NO: 387 - DNA, 599 bp, Homo sapiens
gctttattctaagacgtgaaagaatgagggaaattttgtaccttactttcttctgggtgagaaggcaaatttagggctcaccgtataaatcttgagaaggccactgtttgcgagcataagccacaaagactcaattttggggaaatttgtatcacctcttttcatttagaagaatccatctgagtaccaggtaagagaactcagtaaacagcctggctttgttccttaacaagcctaaattgctagaaagcactcctgtacctctccaccccgccaggctccaccaagctccctcatagrtcctcattctgctcagcatgcctctgtgactgaggcacttttctctgctgaaaagcccttccttcttatcccaggcccaggtcaaaaacagactatggagcacctaccaaggtctccatcagacagactgtcagcagtttggaggagggacagggaaagatattcctgttttcccagagcctgacaagaaagtggcagagcaagggttgttgaattcttttttattttttctcttatagcctaatcttggaagtgaagggaattcttattcctgctgccactggttctcagggtatgca

SEQ ID NO: 388 - DNA, 599 bp, Homo sapiens
gaaaatgcactgctgacttcctgtgttaccttaaatagacagctgaacgcaacaattacactgactgcatgctttattctaagacgtgaaagaatgagggaaattttgtaccttactttcttctgggtgagaaggcaaatttagggctcaccgtataaatcttgagaaggccactgtttgcgagcataagccacaaagactcaattttggggaaatttgtatcacctcttttcatttagaagaatccatctgagtaccaggtaagagaactcagtaaacagcctggctttgttccttaayaagcctaaattgctagaaagcactcctgtacctctccaccccgccaggctccaccaagctccctcataggtcctcattctgctcagcatgcctctgtgactgaggcacttttctctgctgaaaagcccttccttcttatcccaggcccaggtcaaaaacagactatggagcacctaccaaggtctccatcagacagactgtcagcagtttggaggagggacagggaaagatattcctgttttcccagagcctgacaagaaagtggcagagcaagggttgttgaattcttttttattttt

SEQ ID NO: 389 - DNA, 599 bp, Homo sapiens
ttttaaatatgtgctactacagataatgctgcagagtgtgtctttgcacactaaagcagatatgtcaaaaagacagcttcctagaaatggagttactggctcagatgttatgtatattttttagttaatgccaaattgccttctaaaaacacttagaaaatttccaccaatagtatatgaaagtgcccattccatgtctggattttgttactgacattttattggctgcacaaaaaaagcttgcactttaatttacatttccctctttactagtgaagttaaatgtctttttgtatgttrtctatttgtatttcttctccaagaattacctattcatatctctttgccagtttttctactaggttgtctgtttcttgatttgtcacattttaatagattctagatgttaattattttcacatacattgcaagtacctattcccagtttatcgtttgtccatcaattttctttcgttttttcttttttttttttttttttttgagacagagtctagctctgtcgtccaggctggagtgcagtggcacaatctcagcttacttccttccgcctccatctcccgggttgaagcgattctcct

SEQ ID NO: 390 - DNA, 599 bp, Homo sapiens
ggttggataacgggtaataattttttttttatcttttgtaacactgttgaaaactttccagttgatttgaactgttgcagttataaactaacgttctatatgcatttgggtttgtttctggattttcctttgtataccaacttttaaaatttattttttttcttttgtattatctcttctatatgaactttagagtcagcttatggattctgttaagcattttttaattttattggggtttctgtttggattgcatttaatttatggattatttgaggagaacggacatctttgtaataycacatctaccattctggactccttagtatgcatctcctgctcaatcatttccttttatcctattgtaaagttttacagctttttcctctagctcctatacccttttgttagacttattcctaggcattttagggtttttatcgccactgtgaataggatcctttttttttctattgcctttcctattggtgtttgcctctagataataaaacttcatttttatatatttatctctggctatctcattagtctgaataatttttcagttgattttcttggattttctaagcatacaattc

SEQ ID NO: 391 - DNA, 599 bp, Homo sapiens
attctcatcaacaagcagaatatggttttttccagtcttctactacttcacagtccttcatctgatatttaaaatgtatttatgttgagtcatttctttctctcttgctggtgaaccagaagatcacgaaatgattctacagaggcagtagcattatattcagtttctttttttgtatgcatcagataagaggcctgcaaatggaagtaagtcgcctcacatcctcacatcctttgtatgatgatcgcagtaatgtttgcctttttaccactggtgcaacatttattagttcataaaccygcttccaaagaacctaagggctttttgatgaaaggtgactgtggtgggaacaatgttaggttttgacaggctacttttgcttttacaaacatttctcctctttgtttttagtgtttagaaactactaccttaaaagagagttgaggacagggacatgtctggactaagtggaatttagtgcttagagttaggatttggaatataaatatggaagttaatatttagaattaggatttctgaatctgtgaaggaaaggtaaaataaaattttgatgtcagttcagcttaagcttctaaatc

SEQ ID NO: 392 - DNA, 599 bp, Homo sapiens
taggttttgacaggctacttttgcttttacaaacatttctcctctttgtttttagtgtttagaaactactaccttaaaagagagttgaggacagggacatgtctggactaagtggaatttagtgcttagagttaggatttggaatataaatatggaagttaatatttagaattaggatttctgaatctgtgaaggaaaggtaaaataaaattttgatgtcagttcagcttaagcttctaaatcattctcgctgaaccaaagcttccagttggtaaaaatctaagatctgaggaataaaascaacataagaagctgacttttggtaagccttaacagtgatagaagagggacaaggtggcagttcgattctcctattttccccatagactgcaggccccttggctaaccgtaaaccttctaccctttaactccctgtcgtccattcagcaggccttcctgtgacccgtgagtatcagtggaagcattccctccaataagttaccacggcctaagaaaaaagtctaaaaaattatgtttcctgaagttttcacagtatttaagtatttacgtaaaggagtatttgttgtatcctagagagt

SEQ ID NO: 393 - DNA, 599 bp, Homo sapiens
cctatcgtggacaaggtgagtaccatggtgtatcacaaatgctctttccaaagccctctccgcagctcttccccttatgacctctcatcatgccagcattacctccctggacccctttctaagcatgtctttgagattttctaagaattcttatcttggcaacatcttgtagcaagaaaatgtaaagttttctgttccagagcctaacaggacttacatatttgactgcagtaggcattatatttagctgatgacataataggttctgtcatagtgtagatagggataagccaaaatgcrataagaaaaaccatccagaggaaactcttttttttttctttttcttttttttttttccagatggagtctcgcacttctctgtcacccgggctggagcgcagtggtgcaatcttggctcactgcaacctccacctcctgggttcaggtgattctcccacctcagcctcccgagtagtagctggaattacaggtgcgcgctcccacacctggctaattttttgtattcttagtagagatggggtttcaccatgttggccaggctggtctcaaactcctgccctcaggtgatctgcccacct

SEQ ID NO: 394 - DNA, 599 bp, Homo sapiens
acaggtgcgcgctcccacacctggctaattttttgtattcttagtagagatggggtttcaccatgttggccaggctggtctcaaactcctgccctcaggtgatctgcccaccttggcctcccagtgttgggtttacaggcgtgagccaccgcgcctggcctggaggaaactcttaacagggaaactaagaaagagttgaggctgaggaactggggcatctgggttgcttctggccagaccaccaggctcttgaatcctcccagccagagaaagagtttccacaccagccattgttttccyctggtaatgtcagcctcatctgttgttcctaggcttacttgatatgtttgtaaatgacaaaaggctacagagcataggttcctctaaaatattcttcttcctgtgtcagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggcaggtatctcaaaagcctggggagccaactcacccaagtaactgaa

SEQ ID NO: 395 - DNA, 599 bp, Homo sapiens
ctgtgtcagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggcaggtatctcaaaagcctggggagccaactcacccaagtaactgaaagagagaaacaaacatcagtgcagtggaagcacccaaggctacacctgaatggtgggaagctctttgctgctatataaaatgaatcaggctcagctactawtattacactctcctgaagctaaccaacatttcctgcaacattatgtagacttttaaaagaagggcctgaagcattctcacaggataggctaaatgtagaacaagaagctgaagacccgttagagttttcatggcactccttatcagaataaggtcactgtctcatcagttataagacataccactattttatgtgccagcaggaatgaaaaaatgcaattataaccataagatgtttcagaatcaatgacataatagtattgcaaaccagattctagcttaagctagaatgaatattcc

SEQ ID NO: 396 - DNA, 599 bp, Homo sapiens
gcaattagcatgccctgctaagacatctgcaggtagtggtagtgggtttaggactgtctccccagctttccacatgtgtcagagaactgtgaggaatgacagagctcttactcaaaaagcttatttgagattaggtaaagtccagtgagggtaaaattgcacaccttttaccacattcacctggggtcagtgtagacgccaaggttgtcaagcagctcttgcataaggactatgctggcagagaaaaaggcagtttccctgaggtcaaaggaggtgtttcaggcactcctggctccagayagtccctttctggcagagagggccagaaggagagctcagcagcgcagggccacctttctgcagccatcatcacaagtaagggcgagtgcttttgaaacctcaaatgcatccagctccaggaaggggataagtggctagctaaaagaaaaagtctttcaggtttcagtcacattgctggttacctcagcaaaatgttcccagaacacccactcaggtccctgtgtgtcatagtaatgatgcatctagtgactggtggtggcagaattctaagtagacccagctcttaagaaagcagtgtt

SEQ ID NO: 397 - DNA, 599 bp, Homo sapiens
ctgtccaattattcgcttacccactaggctgagtagagacttcaggaaccaaacatgacaaagcatatagaatttgcagaattagtccaggaaagacacagaacaaaccaacagcagcaacaataagaaatagtaacaggtgcaagccctggagagtaggtaatctgacttcaataattgatagagtatttaaaacaagacacacaaagaacaggaacatctgacccatgccataaacagcaatttaaaaaacagtcaatagaaacaatctatgaggaagcccagatgttagacttactrggcaaagactttagatatcagctattataaacatgttcaaggaactaacagaaacaaagtctaaagaattaaaggaaattatgagaatgatgtttcaccaaattatcaggactatcagtaaggagacaaacattataaaaaagaatcaaatagatattctggagttgagaaatacagtaatggaaataaaaattcactagatgggggtcaacagcaaatttgaactggcagaagaaagaatcagtgagttcaaagaccggtcaattgagattatacagtctgaggaatagacagaagaa

SEQ ID NO: 398 - DNA, 599 bp, Homo sapiens
gatgctgggactatggggctttttatttttttgcatatctgtactttacacaataacattttgtgtaatctttttttaaatgcagaatactgacattggagaatgctcttcatatattttaagtgaaaaaggagtaaaaactatataatgtattatctcatttttctaacaaaatgtaaatgtgcatagcaaagatacagaggtgttatagtgccagggaaaaggggtgcaagactagtgtttgcctcttatttcttgtcttgtttataaattctctacattaaaaatataaattccaartgaaaacaatggaataaacacaaactcccactttataaccaactaaaatgacagtaactgaattttctaaagttttaaacccaccaaaatgggagaaatggatgacagcaccagcgtttgaaaggtggaaagtggagggacggtgggcagactacttggctgacccaagaaaactgaatcctaggccagctgagacctatgttgatttacagaatcccaagaatgctcaggaactgggagaagaccaaggacatcagaagagaagggggtgaaaataaggaaagttgttgaaactcagt

SEQ ID NO: 399 - DNA, 599 bp, Homo sapiens
agaggaagaggaggaattagtcaattcctaacaaaagcgagagagcagtgcgtgcagctgaagaaaggagtaaagtctcggagcagctggagctctgtgatgagcacgtgtcttccagatcacagacaggagaggattgcacaaagctctttgacttctctaatgcaagggaccattgcatggcccacaaatcctttaacagtttgaaatgaatgtgcagactccttcaccccagctttcatcacctgggcatttctctatggttttaaatataacatttgtttctaatttgtgtaactrtaagtccatgtgaacctcatggatttttggcttaggcaaatagcttctctgtaattggcagcaattccatcttaataagggaactgtgatttgcaaaacgaaaaaatatactgtttttttctttttccttttttttattcaagggctagtgaatcttgggatctcagggttacatcgaggtatatttatcatcatcattatagtccaggactaaaaggaagttattccaggctctttgcaaagaatctcagttttttttgtttgtttgttttattttgttttgagatggagtcttgctc

SEQ ID NO: 400 - DNA, 599 bp, Homo sapiens
atgttcggttttttttttttgagacggagttcgctttttagttgcccaggctggagtgcaatgatgcgatctcggatcaccacaacctccacctcctgggttcaagagattctcctgcctcagcttcccaagtagctgggattacaggcatgcgccaccacaccaggctaattttgtatttttagtagagacggggtttcttcatgttcgtcaggctggtctcgaactcctgacctcaggtgatctgcccaccccatcctcccaaagtgctgggattacaggcataagccatcggccccrgctcattcaagttttaaacattattgagggcttatgatatgtcaggcacaatagcataggtcactttatccccatttttagaaaaaagcctcacagaggctgagtgatttgtcaaagtgacaaagcttatagtggtggagaatgttggttcatggtattccttgctcttcatgaaatctgtcatgggcctgagtaccttgtttggacatgtgtttttgacctgcctgcattctttgaggttaaggctgtcttacacagctggaatcccccttggtgcgtgaaaccatctgctgtagtgg

SEQ ID NO: 401 - DNA, 599 bp, Homo sapiens
agtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatwtaataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattct

SEQ ID NO: 402 - DNA, 599 bp, Homo sapiens
tctcccgcgccggaaaagggcgtcagcgcacggttcacccagactcacctggccgggtgcgcggggatccgggacccgggcctaggggctccccgggacgggatggcggtggggcgggggaggatggcggcggatggcgccgggttcggctcctcccgtctccctcgctcactccgcggctgagccccgactaacggcccatccgggcaaccgccgcccccgggagcaccccctcccacctcccacctccctccgcgcctagacacgccccttaatttgcataaagggcggggcactttmtaccctaaccctctacttccagggctgtctttagtttaaaaaaaaaaaaaaaagggccgggcgcgcggagcatgcggaggttatttgcataaagaggagggacttaagggcactaggaccccgattggctaaggaggcgggcccccagcgtcggccgttgagccgtgttgagggggcgggaatgcggtgcaggtcggctgggcggttgggacgcagaatttacacgacgaatgtgggagaaagaggcggagcgtgcgtcggacgttagtagaaagatgggagcggagagacgttgggac

SEQ ID NO: 403 - DNA, 599 bp, Homo sapiens
tgcaggaaggtatgctgggagtttaaggattttatgagcttgctcagccggaatgggggttggtaccagagaaatcctcatagaacaactagggctgtacatactcccaggctataggaacctcaagtatttgaaatatcccatcttttcctaaacttgctcctgtattggctcctggaaaaaatcgcctccagatgaaatactgttttaccatatgaagaactgagaaaaagcattatggagccaccttagcaccctgtaaccatgggccagaaaacagagggccaaggccagagccaycttcgttttcctatcctcattaaaaatgtccatcaccagtgtttctttactcgatacctccagctccctaagcaagccggacgacaggtctctcagtccattccagagtgaccaggcattcgtttatggacgggaacagtgtaaagagatgagaaatagtggggaagaaagcagggaaatccagacaggcccagaatgaaagctaaaattggggagaaagaactttatgacaagctagagataagatggatgttgcttcgtaggtgtttgaggaggccaatctgtgaagataaatatat

SEQ ID NO: 404 - DNA, 599 bp, Homo sapiens
tggcgcatgcctgtaatcccagctactcaggaggctgaggcaggataatcgcttaaacccaggaggtggaggttgtggtaagtcaagatcacaccattgcactccagcctgggcaacaggagctaaacttggtctcaaaaaaaaaaaaaaaaaaaaaaaaatctatgaaatccctatcaagaaggctgagatatgtaacattcaatacttttatgtgagattggttgatcatgagcctgcaagaagcaagctggcctcaaagtttcccaaatccacatttattttcctccaattcttacrtgtccaaagacagggaaccacagacacgcctttgtaggaggataactggtgttcacccagagcccacaccccctttaaaggacccagtgtaaagttgggaaatctcctctagtcttttggtatttctactacagccacttccctttaaagagctctaaaacgtatgccccatgcatgcctagctttcaaccatcagaagcatctttgcaggactctcaccagcgggtttctggatctctaaggacttgcccttatacgtatcaaacaggttgagcgaggaatacttctttccatccttt

SEQ ID NO: 405 - DNA, 599 bp, Homo sapiens
aaatatggcatgttgtataaccacatgcgagactgatcctagactgagcctcctggctagaaaaccatctcctcccccaataagcttcccctgcccccagccacaaacccagacctggattgctcacctgggcccatcaggagtggggtatcggtaaggcccctggggtccatagggcggagggaacgggagatatgggggatacatctgtaaaagggtccaacagtagctgctcagagggacagtcatatacccttctagctccttaagcctgctatcaatcatcctcccaccctcccytctatctcataggtcaaagactaagtcctgattcctagctctccagcttccagtgtaatcgttccaagacaagacaccaagactcacgaaaggcggcatcattccgcggtagggagggaactggggtgggcctgaaggctgtagcccaccccggggatcatgaccatgatgaagtttggagtccgggccctccagctcatcagggccacgcccacctccgtccctccaagttgtagaatctgtattttggaaaaggtagagagaggtatcaatgattggaggacaagtgaacacagctg

SEQ ID NO: 406 - DNA, 599 bp, Homo sapiens
ggtggggcagcaggctctgctttgagccgcttgtcaggtgccccaaacttttcatcgagtcgcttgagcttctcagcacaggctgcccggcgctcttcttgcatgcgccgctcctcttcttctcgccgtcgccgggcccgctccactgccagggaaatctcagatgacgactgctttcgtcgctgccgccatgcctcatcctcatcttcaggtgctgggggcttgcagggaggacccccacgatcctgtcaattggcaagacccagcagggccaggggaatcagttactatgctttctaycatctcttttacaacaaatcaactgtcgctacttgcaggatgcaacgacccaggctttggggttgatctctctgggtggtgacaaactcattatcctggtcttctttgagaccacgtcttgctatgttgcccaggctggtcttgaacttgggctcaagtgatccttctgcttcagcctgctgagtagcttggactactgatgcatactaacagatccagctatctagccaccctagtctttttatttttctgttccctctctccttccgaaacccaaacacccagggctcctttttctt

SEQ ID NO: 407 - DNA, 599 bp, Homo sapiens
gacaggggaccaggggaagggggaggaggggaagtgaggccccagccccagaacccctccccgcccacccctttcccccttatatatttataatctatatacaagccccgggggtagggggcaagaggaactccctcagcggggtgggggcaacccaggctccttgtcccctcgggacccaggctcctctgcccgtcgggagggcccttctcgaggtggcggccctgtccgctcccaaggcttaggtatccagcgcagggcatctggtggggaggcctaggggacaggcatgtgttaaasagtgagtcacagtgagaggtcagcgatgagacggaaggacaggaaatcaggtggcaactcgaatttagagttggggccacaagggtttctccttcacctgctggtaaaggtcgacgcgctgggtgcggaagactccactgtaggtggaaggcgtggccttgagacgggaattgaggccagagaaggacctaagggaagaagggcgtctaaggcaagcctaggatccagaccctggttccaaagtaaggaagcacttggaaagtccacatccctattccgtttcaccttccagttggggg

SEQ ID NO: 408 - DNA, 599 bp, Homo sapiens
caccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctgggaattcattgactctgaacctttcattttaaagatgaagaaaatgaggtttagaaaaagaaagtatagtaattagtgtcactgctttctgacagcctgttcagaggaagaggtaggtaagttgtgctgcctgactctgttaaatacctaccatacttctgctttaagcagtgaagatcagaatgtaactccccatcttcccagacccgttggtttgtgccctcttgatgccgtattatttccgtgtgt

SEQ ID NO: 409 - DNA, 599 bp, Homo sapiens
agcagttctcatgccttggcctcccaaagttgctaggattacagccaagagccaccatgctcagcccagctttctttttttggtttcttacagctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccattcacctcatcttcctgtcccccggcccagccaggcagtggtaccttcttgccattatataaccactgggtaagagcccctagtgacatgttaggggaaggggccctgggaattcattgactctgaacctttcattttaaagatgaagaaaatgaggtttagaaaaagaaagtatagtaattagtgtcactgctttctga

SEQ ID NO: 410 - DNA, 599 bp, Homo sapiens
gaatccgctgccgcaggaagatgagcatcagcagcaggatggcttcaagcaccgccaacacgatcactgcagaggacggggcagacagacctaggtcagggccagggctggggccgggcatggcccagggcggtccttgggcagctggtggcttgggggtgggcaggacactcacgggcggccagccaggtctcctgcacgctctggtaggcactgaggttggtggtgaaacccagctgggagatggaggcgcccttgtcccgcagcactcggtactcctcccagcagtagtagatgccrtatgccagcacgcccagcactcccaggatcagcaccagcaccaggggcccagccaccaggcgcagaagcaagataaacagtaggctcaagaccagagccacccccagggcactgtaggcagggtgaggacagtgaggttcagccctagcccctcaaatctttccccttacagaggccctccctgcctttccacacaccacccaatgtccccagattaggcctctttcccttataaatcctgttggtcttggaatccattcggagctctggctcctcctcctctgtccaaagcctgtgtt

SEQ ID NO: 411 - DNA, 599 bp, Homo sapiens
tcagtgggctgcttttgatttcacaaatgggcttctgccctgtggagcccagtctatcccctgcctcccctccctgtcgtgccttggtttggaccctcctctccgctggcctcaactcttagaacaccctgtcacccttccatccaccctccacccgagtggagtgccagggagaccgtggcactgcctggacttcatcactccagggttctgggtccctttgtgactcagacatctccagaggctctgccccagagacagcatccacactccctggccaggcttccaggctctcctgtscaaatccagcccatgttcccttctactctgtacctttgctcttactgtgcctctctctcagggctctctttccaccagaaatcccatccatgactccctgttcaaatccagctccatctcacctcctccaggaagccttctgaccttatccccacctcctttggcaactgttatgtgcctacagagccacttactgccatccttgcaacaactttgccaggcagccttgctttgtcatttatttatctatttatttatttattttcttatttttgagtcaaggtcttgctctgtcaccc

SEQ ID NO: 412 - DNA, 599 bp, Homo sapiens
atcccagcactttgggaggccgaggcgggcggatcacaaggtcaggagttcgagactagtctggccaacatggtgaaaccccgtctctactaaaaatacaaaaattagccaggtgtggtggtgggcacctgaaatcccagctactcgggaggctgaagtaggagaattgcttgagcccagaggcggagtttacggtgagccgagatggtgccactgcactccagcctgggcaacagtgagactccatctcaaaaaaaaaaaattagacaatttatagcataagatgagatatccagttaycaatttaagtacagtaaggagtatctcaagtgaatacttcaaagtcaagtagatctgaatataaattctagcactttccagccctatggtcttgacccaactatgcaacctctctgaaccttgtttcctcatctttagaatgtaaatgacagtgaggtgcagtggctcatgcctgtagtcccaactgctcaggaggctaaggcgggaggatcacttgagtcctggagttggaggttacagtgagctatgattgtgccactgcactccagcctgggcaatagagtgagaaaccctgcctc

SEQ ID NO: 413 - DNA, 599 bp, Homo sapiens
ttaaaaaaaattagccgggcagtagtggcacgcgcctgtaatcccagctactcgggaggctaaggcaggagaattgcttgaacccaggaggcagaggctgcagtgagccaagattgcaccactgcactccagtctgtgtgacagagtgagaccctgtctcaaaataaaaaagtaaaagcaataaaaaaataaaaataaagcctactgatgcccatgctgcagcatcacccaactctctaacccttaacccctccagaccataagccctacctccccaagtctccttagctcagcctcccrtttcgtttctctctcagaagctgcacagatgtcatctgctgcgtcctcttcctgctcttcattctaggttacatcgtggtggggattgtgggtgagtttccagctgctcagagccagggcagtgggtgagggacaggaacccagggagggaccattcccataactgccccactaagtccctgccctccaatgactcatctgtgcctctgtctgcagcctggttgtatggagacccccggcaagtcctctaccccaggaactctactggggcctactgtggcatgggggagaacaagtga

SEQ ID NO: 414 - DNA, 599 bp, Homo sapiens
ccttttccagcttcccagccccttcttcccgtcttctgcagggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcaggtgagtagggggcccggggcctccccaaaaggacaccgagagctgccaagtacagttggacaagcttcaaaccagcaaaggcacctggccaaggaagggttggctgaaagggakccctggtgtggggtcgcatccccaccaggggagggatccttttcctaggtcacagcaaggtatcatatgagctcccagtagccctggggacaccaccatactgattacccgtcaccctaggaccatcaccacccactgttgtaacacatggaccccaaagaaaggacagtggttagggggtcagggggcatcaagagtagaggggcccagaccgatcatggggttgagctgacctctgcctcctcgccccagcactgcacgtgtgtggacgactgctctagctccaactgcctgtgcgg

SEQ ID NO: 415 - DNA, 599 bp, Homo sapiens
ttcccagggcccaggcatcctggaccccccaactctctactgggctgaccagccctcctgtcccttgtctcccctcccagggggaggcccccgctgagatgggggcgctgctgctggagaaggaaaccagaggagccaccgagagaggtgagtgcagctaaaacgggccccaattggaccgtcaccttccctaaacacaggatctcctgagcccttagctctgaactttttctcttcctctacagttcatggctctttgggggacacccctcgtagtgaagaaaccctgcccaaggccamccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggtgagaggctgggtagcctggggggttggtgggaaatttctgactcttgccttctttcttatcttgccttttgcttgcctgttttctaggccatgccacaaagtcattcccctcttcccccagcaaggggggttc

SEQ ID NO: 416 - DNA, 599 bp, Homo sapiens
agctaattttcgcatttttagtagagacggggtttcaccatgttggccaggctggtctcgaactcctgacctcgggtgatccaccttgctcagcctcccaaagtgttgggattacaggcgtgagccactgcgcctgacccaaaagaactttaaaaattctgtttttctatctcatctcttcttttccgcattgccaaacttctcagaagaatagttcacattccagtgagagcagaaatacaaaaagctgtcaagttaagaattagagtttgtaaaattttgtttcttgtccctttcttsctacttttcctttctaggaatgtagatgggacagggggcctaactcagcccatggctcaagacaggtagtccttggtggcaggtggagttgacagccaatgaatccttcaagtgtccagcccacccagttacaactctgcgtaaaaacaagcagaggtgcacaaactcttttccatgtagtctggtggagagatgatgtggagccatttcccatgcatcccatccagggggtttacaatcatctagatccttgtcccttcttccccaacttctgccagtataaaaccaggggctttcct

SEQ ID NO: 417 - DNA, 599 bp, Homo sapiens
tcaagcaattctcctgcctcagcctcccaaatagctgggatgacaggcacatgccaccacgccaggctaatttttgcaattttagtagagacagggtttcgtcgtgttggccaggctggtctcgaactcctgacctcaggtgatccacccacctcagcctcccaaagtgctgggattacaggcgtgagccaccatacccggccaacatcattctcttaaactggcctttcctccttcaggatctcacactccctatagcctcgcttctgctttctgggatcacctaaattaactacctayggccaagtcctgtctcaagctctgctgtcagggtcaccaaaattaagatcatccctttccatcctcctctccctataaactactgcccttcttccacaaactccttccacgccagcaaacccagactgtaacattaacacagagttataatccatccatatactggtctctccacattcctggagcacaaactgctaaagggtaggaacgctgtgacacgtttggttcccccactgtccagtgggagagagatatgtgagccagtcagcgctacaccgagttgaggcagccattgaggc

SEQ ID NO: 418 - DNA, 599 bp, Homo sapiens
cagctactcgggaggctgaggcaggagaatcacttgaacccgggaggcagaggttgcagtgagccaagatcatgccactgcattccagcctgggtgacaagagcaagactctgtctcaaaaaaaaaaaaaagagtacacaaattgagactccccttggacagggctaagtgcatgaaaatcaggacatcctggtgttagggactccaaagtggctgctgtggcagagctgctagtgcctcccctgcccctcaagtatcttttctccctccttccacagtaagagatggttaggggaacayacagtcacccagctaaagaccatatttcctagcttcccttgcagctaggtagccaggtgacttggttctggctaatgggatgttagtagaacttatgtatgtcatttccaagttatgtccctaaaataaaaaggcagtgtgccttttcttttcatgggctggaatataaacctagcggagatccgtcttccaccaggaggatgagggcaacatgctggggatgacagagcaaacagacagaggagcctgggtgtctgacacagtgttgatgtcataccagccctgcacagccacttaga

SEQ ID NO: 419 - DNA, 599 bp, Homo sapiens
tctcaaattcctgacctcatgatccacccgcctcagcctcccaaaatgctgggattacaggcgtgagtcactgtgcccggtcttattttttttttttctttttgagatgtagtcttactctgttgcccaggctggagtgcagtggcacaatcttggctcactgcaacctccatcttctaggttcaatcagttctctaaggactcacttataaatcaaaagggtttttacgaacctaaatgatcacttcagagaggtttcatgttcatttttttattggtcttatttatttttaccctacrttgttcaaaaaggtattgaaaagacttctgtgggtcagggagactaacacactagcttcaagtttctttgcttcctgcatttcatacaagtgtaggttatgatttaaaggcatatcccagcccccgcaaaagttttattcctttgagtaaccaaccccaaatgtatttactttgccagttgggaatttcatctactagactttccgtaaaaatgttgtaaacatttttcctgtctccaaaactaagtgttgatttcattttttccacctagattatctctagggaaggattgtagggaa

SEQ ID NO: 420 - DNA, 599 bp, Homo sapiens
agccttcaggagggacgtcatctggccagctcatcatgctgtacactgcctggagggccttcttggtgttagtccctgacttcaacttgtggtctgtggagagggaagagaccatcacctcacctggtcttccaagccatcttttaaccccagagaccaatctgcaactgaaatcccacatctttcaactttttaagttaatcatcattacacggacttccctttgaccacaaagtggcccttccagcccccaacaggttcccactaacctccattgcccaacgatcctgctgttcaacytttgactacaaagtggtcctccctgtcgccctcaaggtagtctcatgaccccctccaccctgaacctcctgaccccaaagtgaacctcccaccattccctaacctctgaccttcataattgatttcattgagctgcttcgtgacccagtctgcattactgctgtctgcttcagacactttgacccaaattttggggtatgtggcatatgtcactagaccatatcttggcttcacaccataacttgccacctgtgggtgaggagaacaaggcgccatggcattgaaaatagaatactgtg

SEQ ID NO: 421 - DNA, 599 bp, Homo sapiens
atcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctayagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtc

SEQ ID NO: 422 - DNA, 599 bp, Homo sapiens
ggatctggaacacaggtgttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacctgcagaggcagtggggtgccatggatcattcagtagaattcctaatcctggaagcatggctgttcctgcttgygtcttagctgacctaaaggaatcagactagggacccagctcagcctcgttcttgacacacgcaggcaagacatgcggtcctaaggtgaggcaggctctgcctacctcgaattactagccacatgcattgagctttcctgctttggggcccatgctgaccacttggcatctccccagataggaaagggaggactcacttgaatgaaacgacttctcttgtgaactatcaaggggccgccagaatcacctgcaaggagaggagaagctgtagagaaaaggactgttgggccttgggcactt

SEQ ID NO: 423 - DNA, 599 bp, Homo sapiens
gttggttcctcttgataaagaaagcctctccctattcacacagaaaaactcacattctcagattccttattcagtctcctcctaggatagcaactcctggaataacttctttggtttatctgtaatgttttcctccccatcctctgcctcccctcttctgcttcagctcaacgggacccaggtggagtctgtacagctcaaagtcaacatagcccgaaaacagcccatgctggatgccgctactggcaagtctgtctggggctccctcggtaagaatgggattcttcctttcccatcctytcccccacaggccattccttttggttcccccacacatccttgggtttcctagagatgatcgaggtcagagtgtgtgcggaggctatgggaatgggaaggaaaatttcagatcctctgtcagttagaggtaaagaaaggagagaaaaggattgaaaacagcttccaaagcagtgactggaacagggaagaaagtgggagctggagtgagattggtgaggaagatgagtgtctcatggggcttgttcattttgagatggagtagagtgagtttcataagtattcgaaatcagggatctgga

SEQ ID NO: 424 - DNA, 599 bp, Homo sapiens
gtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcagtgagtgattttggctggaggtcaaggtgaccttaactgaggtttatgtgggtcctactaagtgaaatgtggcatggkctatgtcttgtgactatgatttgtgctcccaaagggtcggattcattccctgaacggcgagcccctaggaaagggaatactctctatgtatatggagaagacatgacacccacccttctccgtggggccttctctccttttggaaacatcattgacctctccatggacccacccagaaagtaaggatgacaacagggcatgatgagaagtcctgggagaatcctggggtgtgagacctgagggaagaagctgccctccctgcagccgcctattatcactgggtttggttgggtccagaa

SEQ ID NO: 425 - DNA, 599 bp, Homo sapiens
tactgaattacctggggcagattttggatttcagaaacatggaggctggacctaggaatgtgcatttttaaaaagctccctggctaatcatgaagcacactgaaattggagactcactgattttagaaaaaggggtcccagacctaaggatgaaaggttggaggctcaaagcctatcatctcagtcaccaagtgccctggtgcttggatacagaagggagctccacggagaaatgccacatttgaaagagcagctctcaaagcaaaaatatccccagccctttctgctctgtcctcacaygtactgcaggtacactgggctgtaatctgtccagcaccccttcaggctgggatggacaggagtacaggcacagatgaacaaggttaagctagatcctactgtgaggagggtgaaggaggtttggactcaatgcgggtcaaaggttagggtcaaaagtcactcacgctactctctggagctccaggcaagttcagcagctcccagtgccccgtgcatccgagctccacggcccgaaggggtaggtccaggggatctggagggggtagcactacggggaaaggtcaaaagtcaggggtcaa

SEQ ID NO: 426 - DNA, 599 bp, Homo sapiens
gagctggagttggacaatctgaggagcaagccaacaaggtcaaccttgtcatgtccatctctgttccttaggagaaggacatgacttctcctacaccccactcaaaaactaaaactaaccttttggtgcaaagtccatgcctttcttgaaaccaggtggaatagtaagaagatctgtaggatagggacatgaaatcaggtcactgcacactggtgaacaaattgtgtacattatataaacctaaaagataccatttacaggacagatgctgtagatagggatgtttgctatgacactttyccaacagatgacagtaaaggttgttgtagaaatttcccagcagatgacagtaaaggttgttatggacagaatatctttttctaattttctcaaaaacatgggagggctagcagtagcccagtgatagcctgggctcttcctcctcaaggctcagactcagagccccaccttacctttctcaaagtctatctcctcctcagcctcctcccgtgtgttcagatctgttatggtgggttcatccatcccccctgggaagagacaggacagacagggattcatgggatgagggtaatacgaga

SEQ ID NO: 427 - DNA, 599 bp, Homo sapiens
cagtgtcccctctgggacctcctggctgtcccactgcctcattctcatcctcgtcacccccacccaaatccagaggctccaacatacagctaaggcttagtagtccaggagctggagttggacaatctgaggagcaagccaacaaggtcaaccttgtcatgtccatctctgttccttaggagaaggacatgacttctcctacaccccactcaaaaactaaaactaaccttttggtgcaaagtccatgcctttcttgaaaccaggtggaatagtaagaagatctgtaggatagggacatgraatcaggtcactgcacactggtgaacaaattgtgtacattatataaacctaaaagataccatttacaggacagatgctgtagatagggatgtttgctatgacactttcccaacagatgacagtaaaggttgttgtagaaatttcccagcagatgacagtaaaggttgttatggacagaatatctttttctaattttctcaaaaacatgggagggctagcagtagcccagtgatagcctgggctcttcctcctcaaggctcagactcagagccccaccttacctttctcaaagtctatct

SEQ ID NO: 428 - DNA, 599 bp, Homo sapiens
caggggtagcagtgataaagatacaaccagagggctctcaattagcactcctcccaaaagatgtccctttcttcccctcagacccatcctagccagcccacatcctggtggcaaggctctttcttgcctccactacacagaaccaccaaccttcaacactaggtcttccaagctgcttgctcgggccaggggagcactgcagggagaggctgaaacagtgtcccctctgggacctcctggctgtcccactgcctcattctcatcctcgtcacccccacccaaatccagaggctccaacakacagctaaggcttagtagtccaggagctggagttggacaatctgaggagcaagccaacaaggtcaaccttgtcatgtccatctctgttccttaggagaaggacatgacttctcctacaccccactcaaaaactaaaactaaccttttggtgcaaagtccatgcctttcttgaaaccaggtggaatagtaagaagatctgtaggatagggacatgaaatcaggtcactgcacactggtgaacaaattgtgtacattatataaacctaaaagataccatttacaggacagatgctgtagat

SEQ ID NO: 429 - DNA, 599 bp, Homo sapiens
gggctccatgtgggagaggaagtgcgggccatgagtctgcggagggactggctaacttcatgctctcttcccagcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcggtgagagatggacactcaatacaggggagttttggctgggaagatgtggccgttgtggagagtgtgctgtctgaggagkgggtggagacgagccactggggagtcaatccttggcctcttctccccagctccatgctgtacagtggctcagatgttattcgggacctggagtgggtcatctttgatgaggttcactatatcaacgatgtcgaggtaagggccatgggctccccagaacccggcagtcctctcctttgggaccagttgagcgtctcccttattccacacactcagggccccttactgctttctttacccccatatggaatcctgtgcctctttatgggcagaagggcggcccctgccctcatgtgacct

SEQ ID NO: 430 - DNA, 599 bp, Homo sapiens
gggcacttacagggctggagggggtcacctgggggactacctgaaggtgaaggtcaggaatgccacagccctggcagggagaaaggggtggtgtcccctacctgcttgagggtgtttgggagctgatccccagcgtccccagggctctggcagaccaggccagagagcaaggcagcaatctcctcaggccgcagggtgctcagtgcattgtcaaacatgagctcagtgaggagcaactcatggctgctcatggcacaagccacccgccctgccagcttcacagtgcccgcctcgtccacrtaacccagggttcggagcacctgcaagaaaaagggtgggcattggacacactgctgtcccctagcccccctgccccaaccactgccccacccacctctactcgctgatggtactcaggaagcagcagcaatgactgatccgacagtaggaagcgcagccgctccatctccttctgtatctgcattcgctcccgcagcttcaggtactgcagagagccacccgtcagccttctccttgccccttagcaggggtgcactgaggacaagggctgagatgggggcggtcagtctacaggggac

SEQ ID NO: 431 - DNA, 599 bp, Homo sapiens
ttttatttgttttaaacattgaatcccatactcctccccaccttaccctacccagaatttagactgttaatgttttgaagccacagcctgcatcttaatcactattttatcttagtgcctggtcttagaaattatattgactctttgatagaccatatataaggcaggtggatgagaatgtgggtagctagttggaaaaggctgcttggtcatttgcttgattattttctcacacagtttttcctttactaagagaaaatgcccccatattggcaaacaaaatctccctgcctgagagcrcccagagtatagcagagcatcttaccctgatacgcctcttttcactctcttctctgtggagacagaaggagcttcaagagcagggggagatcagaatcgtccagctgggcttcgacttggatgcccatggaattatcttcactgaggactacaggaccagagtatgtgactgtgtgcgtcaggggtgctggggggagggcacaggttgggggagacagggaacttgggaaacagaaataaaaacaaaagaaagaatttccctgcccccacatcccatggagagggcacagggccctggt

SEQ ID NO: 432 - DNA, 599 bp, Homo sapiens
cctgagccagatacagcctctcaaaattagatttttatttagctcctgcccagttgttttttagctttgggttttttttgttttaatgtgaatgtttaggggtatcccagctcctaccattctctatcctcttagtcccagtatgattaacatcaagcttttacacttcctgccaggcccctgtgtgcttttgataagccaccaagaactgaattctatttcagggctctttctaaggcccaggtaagataggcctcctctcttgtggggaggaatacaaacttgggtcattttattaamaagaagagtcagctttttggcagcttttctggcaggttcaccaaaaaaacaggaggacaggctggatggaactggagggaggcagggaagcaccagatgcctgactttggttggttccacaagtctcacgtgatttctgagtccctgaagccaaaggtctgtgtcatttggtcctgctggaaactaaggtccccacaggctggaagtactgaagctagaaatttctgcactgccccagcatacggtcggccatcacaggccttgaggacctacaagcagagatgagagacatggtccat

SEQ ID NO: 433 - DNA, 599 bp, Homo sapiens
  misc_feature (300)..(300): n is any nucleotide
ctgtaagggccgggggcattttttctttcttaaaaaaatttttttttaagagatgggttcttgctatgctgcccaggctggtcttaaattcctagtctcaaatgatcctcccacctcagcctcaagtgtgagccacctttggggcatccccaatccaggtccctggaagctcttgggggggcatatctggtggggagaaagcaggggttggggaggccgaagaaggtcaggccctcagctgccttcatcagttcccaccctccagcccccacctcctcctgcagacaagctggtgtctangaactacccggacctgtccttgggagactactccctgctctggaaagcccacaagaagctcacccgctcagccctgctgctgggcatccgtgactccatggagccagtggtggagcagctgacccaggagttctgtgaggtaaggctgggctcctgaggccacctcgggtcagcctcgcctctcacagtagcccccgccctgcccgctgcacagcggcctgctgaactcacactgtttctccacagcgcatgagagcccagcccggcacccctgtggccattgaggaggaattctctct

SEQ ID NO: 434 - DNA, 599 bp, Homo sapiens
gtggccattgaggaggaattctctctcctcacctgcagcatcatctgttacctcaccttcggagacaagatcaaggtgcctcacagcccctcaggcccacccccagcccctccctgagcctctccttgtcctgaactgaaagtactccctccttttctggcaggacgacaacttaatgcctgcctattacaaatgtatccaggaggtgttaaaaacctggagccactggtccatccaaattgtggacgtgattccctttctcagggtgaggacctggagcctagacacccctgggttgtrggggagaggctggggtggagggagaggctccttcccacagctgcattctcatgcttcctgccgcagttcttccccaatccaggtctccggaggctgaagcaggccatagagaagagggatcacatcgtggagatgcagctgaggcagcacaaggtggggactgtacgtggacggcctcccctcggcccacagccagtgatgctaccggcctcagcattgctatgaggcgggttcttttgcataccccagttatgggcctgttgccactctgtactcctctccccaggccagccgctcag

SEQ ID NO: 435 - DNA, 599 bp, Homo sapiens
catcagggtcctggtgtccacagggcccccatccccatccgtagttccccagtccctgtgaggcactgacccagccagaactctccagagatgttcccaaaaccatgggcatagtcctcccagtccctccagaagtctgtctgtccatccatgcggcgctggaacacctgggaagcaagtgggggcaccatcagcctctggctcccggggcaacagaccctgccctgcacagacccctgggcttcccaatgccacccaccagccagccgcccccatcagtctccatgtcgcaaaacacgwtcaggggccgctcgcggttgccgttgaggaagatggtgctggtcctggaggcaccggctccgttctgcatctcctccccgcagtccctggggaaggggatccgcagcccacctgggagaggagagcaggggccagtccttttccaagccttaggccctggctgcccacccagcccccggccccgggcccgtgcgtccaggtacccgtggtgaaagaggtggacacgggcggcaggaggctctggccccacatggcctggagccgtgcattgtaggaggtggagggaaagaggccaagga

SEQ ID NO: 436 - DNA, 599 bp, Homo sapiens
gtctcagttgccttctggaggtttctaacagtgcagctctgccagcagtacaggccgggggctcggggatacctcaccggctcttattccaagagtcactgaacggcgaacacaaagctgccccagccctcagcctgctctggaggggcacatttgatgtatgacctctgttgacagcaccagcaaagcaagttgcccttaaacccttaaactctgtatccccctatattacctttcagccccacaagaggatgtggacgagacccccagccctacagaaccaggcacagaggccccagrgccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacaggtgagtgagtgtgggtggggcagggtt

SEQ ID NO: 437 - DNA, 599 bp, Homo sapiens
atggaagaactcacgatggggttattcatgacagcagatgtgtcaggaacacaaatgacccgtagaagatgattaattttgttatagtgctttcaccgcaacgcatcaaataaccattgaaacgatgatgaatgctggttgtgtagccgtgaggtgaatgattacaatgtacttgtgtacaaaaaaggaagtgccaagaactttatgaacactgattgcaactttaaaacacgctctgcatgcaaaatacaggaagggaatgtgcactacacacattgttattaatgccggcagctgggrgagaaagtaggactatgagattcttgttttctgtttttcaagctttccacataatgttgctgtattattttcactagaaaaacgtgggctaaaaaagaaattctgggctgggagcagtggttcacgcctgtaatcctagcattttgggaggccgaggcgggtggatcacctgaggttgggaattcgagtctagcttggccaatatcatgaaacccggtctctactgaaaatacaaaaattagccaggcgtggtggcatgcacctgtaatcccagctactcaggaggctgaggcaggaca

SEQ ID NO: 438 - DNA, 599 bp, Homo sapiens
tgagattacaggcctgagccaccacacccggccctggttggtgttcttataaagcatcaattctgtcctgcaaaacaaatttgcttggcagctcctaagggtcccaggcctgcacactgagcatcacagggatgccacctgagcatcatgacttcaccacaggtgtggtgttaactgaacattcaaagcagaaaaatgatattctaagcttggggcaccagcatccagactgtgggcccttggtgtgtctaagagaatcccagagtcccttggttaaaaggaggcccaccaggcatgccyacccattctattttctgatgcagccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacg

SEQ ID NO: 439 - DNA, 599 bp, Homo sapiens
ccaaagtctcggagtgaaggcaccagcagaaccattcccaggagcttgggaggcttggtctcagggaaagtaaaataaagccaccagatactgacaataaaagggaaactgagtctagttcagggcagggcccagtgccctactgcacactcaccagttaaaccaacagcagacacggggcccacgcgctggccaccgtggaagccgtacaggttcatcttgtacttgtggtctggctccaggcccgagatggtgaccccatcctcgtgtcccggcacccgcaccgccttgggctgcccrtccccattcttaaactggaccaagaaatggtcaaactggccctcggggactgtccaggagaggctgagggagtcggaggtgatgtctctcactgtcatctgccctaggcgcagctttgcaagaggagcatcaggggactcctcttcgggggctaggaagagatagaaacagaatcttttctcttgctgcaaggaggtgttgaggccccagctgtcttgaattcaggtcagaaggtgggcccagtctggccctaacttaagatcgatttctgattataatcataatcagattttgtggct

SEQ ID NO: 440 - DNA, 599 bp, Homo sapiens
tcgtgtcccggcacccgcaccgccttgggctgcccgtccccattcttaaactggaccaagaaatggtcaaactggccctcggggactgtccaggagaggctgagggagtcggaggtgatgtctctcactgtcatctgccctaggcgcagctttgcaagaggagcatcaggggactcctcttcgggggctaggaagagatagaaacagaatcttttctcttgctgcaaggaggtgttgaggccccagctgtcttgaattcaggtcagaaggtgggcccagtctggccctaacttaagatcratttctgattataatcataatcagattttgtggcttccttatggtccctcaaccatgccaggcagcctcctacctcagtacttttacaatgactgttccctctacctaaatgttctttccccagatatcttcatggctcatccccacacttcctttaagtctttgttcaaaagccaccttcttctgtgggccttccctgattactctatttaaaatttcagttttctcaattgcaatgtatcctccttctatagacctgatttcagcaacaaattgggaaacaacaattatgagacact

SEQ ID NO: 441 - DNA, 599 bp, Homo sapiens
attgggaaccagaggagcccagcccagctgtgcccctttccgagggttcagtccaagccctcccctgcccctgggggctccctattgccagaaaacttgcaataacaatgtcgtcagcgtcctcaccgtccaggaaggcagcaggccagctccttctcaagccctgggatggctcctcaggcagacaccagatcccttccctgcctgagctccccggcatcatccccctcaacattctcacaggcagcccacgctccttcaccaggcccagtgggagccttagttctcccgggccagccrgtgcagaataagaaagggaacggagaagggtgagaactacctgtgtcgtaacatcctgcctccctgacctgccgagtgcccccatcagggatcctgcgctcctcggggccggccaaatcacccctttcctcaggggccggccaaatcacggccaaatcgtgtgctcctgggtaagaggagatagagacccagtctgtaagaagctgcaccctgctggggaagcagtctgtgagaggcggaaagaggctggacagaaaggggagtaagatgaggcagggagctagggaatctcttttcct

SEQ ID NO: 442 - DNA, 599 bp, Homo sapiens
ggcctggcagccatgactcaccagtcttggccaccacagactcgggccccacacgctgcctgccacgaagcccgtagaggttcatcttatacttccggtcgggatccaggccggggacagtaacctcattctcatcccccgcaacaggcactgcctggggctgcccctgtgcatccttgtactggaccatgaatgagtcgaaggggccctgggccactgtccatgagagacgcaaggagtctggggtcacgccggtcactgtcagttcccccaggaggggctgctccaggaactcagggygggggggctcctctttcctctctggagctgtaaacaaggagatccagccaggtgctgaactggcagcctgggactggggcttggggtttcgacgggatgtcacacctatggggggtggggggtcactagtccattaattcgagtgctaaacttctgggaagcctgacacagccagggtatgacacaccttctgggccacggggagctgctgcttgggatggaaggggcccagcagtgcgggggagtctggctgcccctcagccctggagtggggccgggaagctggagtcagctgtctt

SEQ ID NO: 443 - DNA, 599 bp, Homo sapiens
gggctgagaaggggtcacatgggggctgaggtggctgctactcaccagtggtgccatcggccgtgagggggccataccgcttcttgttcgcaattccaaacagagtgaatctgtacttgtggtcagggtccagtgaggagacaacaaatgaacgctcgggcccttccacaggtaccacctggggccgtccatccctgtccctgtactggaccatgaaggtgtcaaactggccctcagggacagtccaggagaggtgcagtgaatctggggtagggtctgtcacccacaggtttcccaggyggggtggagtccctggacttgggtcactctgaggcactaggaagagtgggtagagagaagggagagacttaggtccaaggagaatggggaagccaaatcccacataggaatgctgtgtgaggctgtgcaggttgttcactgcacaaaagtgcatttgctgagggagtacagagggactgaaatccagccagcactctgcttgccgagctgtgtgccctggtgaggagtggtgtccactttaaggaatgggtgccttctttcaaacggcatggaagcactgcgtggactagtgtggctct

SEQ ID NO: 444 - DNA, 599 bp, Homo sapiens
acccattctcttgggcagaggtgccaaccattgagggcatgaggatgcatctcttggaggagacaacagttcggacagagtggaccccggctcctggccccgtggatgcctatgaaattcagttcatccccacggtgagagagatgccaggctccaggaggggactgagtgggcaggacaggggggcagggctcacctcctggaggaagttccaggtgatcattggttgagtccagatggctgggtacctgaagctgctgtaaaggctttcttagcctgcttgacactgggcactgaggyctctgcagcatctccagcaagcattggtcccacacagttggaacacctggtaacagagagctcagtacttcctgaggctgtccagtccattgttggtcatcactgttagctgttatcattgttgcagaatccgtctgcccctattctagcacctgtccgttggccctagctgggtattcatcagcagctggaatgttttttgctttccctgtgtcctacaccacaggccttcaggtatttggagacaccagcctgatgtcttcattcctcaggcaaaacctcccagtttcttcgcccct

SEQ ID NO: 445 - DNA, 599 bp, Homo sapiens
gtcacattggaccgtgaagagaaggggcctgctctggctgtgctcagcagcaccaggagaaccaggctggaggttagagcatactgggctggcatcattcaggaggctgcagggagaaagggtaggtatgagagcagcttcaaaaaggagacaaaatgaatccccccttctccagcacatacccacggtcccaccacccacaagtaatctacccaactcacatgcatgtaaaaattcacattccgcccaaccctaaaggataccctccctgggcaagtctgttctctacctctctgataycatttatttaccctgctcctcacccccttttctattgtgttcccctacactggtttttttgttttgttttgttttgttttgttttgtttgtttgtttgagacggagtttcactcttattgcccaggctggagtgcagtggtgcgatctcagctcaccacaacctccgcctcccaggtccaagcgattctcctgcctcagcctcctgagtagctgggattacaggcatgccccaccatgcctggctaattttgtacttttagtagagaccgggtttctccatgtcggtcaggctggtctc

SEQ ID NO: 446 - DNA, 599 bp, Homo sapiens
aggctggtctcagactcctaacctcaggtgatctgctcgcctcagcctcccaaagtgctgggattacaggcatgagccaccgcacccggctctacactggtcttttgtttttcccacgagcactacaagctctcactactccaagggcctttgcattgtgtgttccctatgtctgggatgctcttcactctgctcataaaggctggctccatcttcaaatcttaactcccagttagggcagtcttccattactctctatcacaatatcctgttcctgttcttcatggcatttactgctgyctgagttatcagtttacttattacctttctctcaatgctacaatgggagctccttgagaacaaggacctcatctatcccaggactgctgtatacttgtgtctggcacataaatgttctatctgacacatcaatgttgaatgaattagtggatgagtacctagggccaatccttccccaaacacctggatcccagctcctactgtcttctaagaaaagtgcagattatcttctccctctctctctcacttttttttttttttttgagatggaatcttactctgtcgcccaggctggagtg

SEQ ID NO: 447 - DNA, 599 bp, Homo sapiens
ccccagcccttctctcagcctggagtgtagccttgggtaagagatgggctctgaccgaccctcaaatcctgtcactttgtgtctaaggccatgctaatcactcccacaccctgggaatgcttgcacaaagatgtgtacacatgtacacttacaaatatattaatgtgtgctcatccacaagtacaaacatacctgcacagacacacaaatccacccccaaaacctgcatccttgtaggtacacatatgggtgcccatgcacacacgtgcacacacacccaatctccccttcaggtttccyccacacctagtcattgggtgatgcctaagaaggctgatttcttgttggctccgagggcagctctgtgagtgaaagaacctggatggtgtgagaggaacaaagcaggaggcccttcccagtgggaagcagcggacacatggcctccaccatacttccccgtacccctggaggcctctgtgagttgtccagtgcccctccccaaataagtggattcctcatctttccctgcacagtgggggaaagcagagagggtctttgcaccaggaaggagtgaagagagctcaccagcttttctggaa

SEQ ID NO: 448 - DNA, 599 bp, Homo sapiens
tgcaggaccagaaactgccttcctgtctctcattgcacccctaaccattttcagctggggcctggaaatcctttctcttaatttttccattcccaggccgattagctccccagaataaggggtatctggattccccaacctacccctccctgacacctccttcctacctggttccagcccaatatctgagacccccacattccctttttagtctcactcctagaatccttctaccttcacctctcattgccagattcaactgagggtgtagcaggagggtcagagggaggcatgggggcrggaccagaacccccatctgtggaacatcttttatggaagccagcccctctccccaccccttgggacctatacagtccctaatgagcaaagtgtcaaagttggctacaacacaaaatacccaggaagctgagtcacagtttgggaagatgcccccatccctgccagccctccaactgtggggagggtgccaagagggtgaggccatatctctctccaaacacacactacagagaaccaccccagacatagtggcagggggaatggtgaaggggagacacaagagacacccaattctttgc

SEQ ID NO: 449 - DNA, 599 bp, Homo sapiens
caggctccctgtgaaggagtgtctgggaggagagggtggtatgtgtgtgttggggtgggcagtatgtgtcagggtttggatgggatgcagacaactgagaggggctgggaacaaaccgagggactccgggagtcagatggtggaaccagggtagaggtggttattggtgaggtgagcccctgggccctggaggtgctggggctagcgggaagataggactaggctgaactggtggccagctgaaccttggaaggaaagtgcttgcggaatcccaaatgtcgggctagagcagctgagccyaggctctgggggctccaggctccaggaggtgccagagggtgcttctttgggcatccaaatggggactccctaggtggcagcgtgagagttgcagggagggaggtctgggagatctctttaggaaatactgaaatgggacagtcaggactcgggtctgggacgtgcacagagcctgcagagaggatcctaaaacttgttcttggccagagctctgcactcatgactcacggttcagcagggctgggatggctgagagatgcctctgggggcacaggggctccgtcttcactctgtgcccc

SEQ ID NO: 450 - DNA, 599 bp, Homo sapiens
ccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtggracaagggaagttttttcattttggagctagttactgggagtaagggagggtggggtgggggggagttcaggtttatgtgtgtgcatttcttttttattattattaaataaacaacttggagggagttgaaggaatggtggctgccttcctggctcgtgatggggagtttgggggaaagtggcttttccagagccagcatcaaagaatcaagcactgaagacatagctggctctgaggtggggtgggtgcgggatcacagaccgcatgtcatccccttgcccccacccctgcaactctgg

SEQ ID NO: 451 - DNA, 599 bp, Homo sapiens
tctcgtcctttcccattcttctgagacccaggcccctagtcctgaaagtccccagttttgctttcctccaaaaatctgctccagcttccccgttccacccacatataatttagaactataaattccacaattccctgcggttaaggtagccgcgccaactacggacacccggtcgggtcaataagtacctgcgcggccaaagtgcctagcatggtgacaggaggagccgggccattcgaatcacctctccttccaaagctaaatggctactgaatgctgccctcggagccttgccccacrcggagagggcagccggagaggggcgcggtgcgggaggcgggggtagggggcggaacaactgggaaagatactgacaactaaccctggagcccgcgagactccgaatctagtcaaattcctggcagccaatcgggagaagggaggaatctggttagcccgcctattgaacgtgacatcatttcctccgcaaccatgaagctccaggccttagcaactgaactaggccagagcaaccgaactaggcagaatcgaacagaatttggcgcggtcgggctggccaggctgctcaagagtcaaag

SEQ ID NO: 452 - DNA, 599 bp, Homo sapiens
aatacaaaaattaggctggtgtggaggtgtgtgcctgtagtctcagctacttaggaggctgaggcaggagaatcgcttgaacccgggaggcagaggttgcagtgagccgagatcacaccactgcacttcagcctggcgacaaagtcgccttatccaatttcctttcctttcctgaggtagaaaggaatttgagaaattctgtctcaaaataataatttgtaaaaaaagaaataagaaagagtataggctctcccccaaagtgtagatactacatgcttgttgactgactcacactatctycctcaagtctaattgtgccagagctcagctctttggaggcagtcatcaaggaatcaagacgaaagagagccacaaaccaggaagattatatccttaagcctggctagagaacaagacatttgagaaagatacataaagaggatgacaagtgaaatttgcttatctgttgggatagatgcttggactggaaagtggggaaacagcaatgtctctctcctctccctttcccctaaagatttgagaatgaaatggaagatgagcaggcatgagaggaagagatgaaaaggaatcttcttccc

SEQ ID NO: 453 - DNA, 599 bp, Homo sapiens
ctcccaaagtgctgggattacaggcgtgagccactgcgcccagccaagaaatctttactgagggcctcctttgtaccaagcactgtgctacatgctgggaataaggcagtggaaaaagccttggatctctggtaacttacattgaattgaagatgacagacgataaaaaaatcaataaaatttaatacaatgtcaggcactaacaagtgctatgaacaccatgaagcagggtgaggggtaagggaatgggatagaaagtgctcccaggtatgcatggtgctatatttattgatgatgatkattattattatttatagagtcttgctctgttgcccaagctggagtgcagtagtgtggtcatggctcaccgcagccttgacctcctgggcttaagtgatcctcccaccgcagcctcatgagtagctgggactgcaggttcatgccaccatgtctggctaatttttttttttttttttagagacgaggtttcactatgttgcctgggctggtctcaatctccaggcctcaagcaatcctcctgcctctgcctcccaaagtgctgagattataagcaagagccactgtgcctggccatggta

SEQ ID NO: 454 - DNA, 599 bp, Homo sapiens
aatctaacccagaggaaagagagacacctttttgctacagtgagggatgaattgatccggactttgaaagatattgtaaataaaatttgaccaagtagagaggcagatgtcaagagggggagaacatcatgagcaagagcctagatgtggtctaaagcctctgaaatttgtgacaagctgcaaacaatttggtttataataggcagagatttgggaaggaggtctaagatttgggaacagctgggcaaatacctggaggtgggaatgatgagtaattcagtatggttagaaattagaatraacagagaagctggatgattttaaattatggaaggtgttaaaggccagattaaaattttgtaaataattgagtaggcaatagggaaccttgaagggcttttgagcagtggagttatgaaagtgtgtttagggaggctgatctgacaatagtgtggagggagacttgaggtagggagaagtaggaagtagggagacctgttgggaaagctgatgcaataatcctaatgaggtaatttttccagcaagggctggggaaaaattacagattcaaaagacattgtggtggcagaactgactag

SEQ ID NO: 455 - DNA, 599 bp, Homo sapiens
tctctctgtttacaaggtcattgcttggtctaaatttgtctcaatcaaaacatttttgcgctcagaatggtgtagagtgacgatgaggtggcggtaaggggttgagcgctcacgcgaacgcctaagtgaccagaacgactggtgtgaagccgtgatctgactctgtggagcctgggactggtttcagcgagagcctctgtactgctctgtagtctctgctaggacatggacgaaaagggacgcagccgggagagcgactgccccaggtgggggctggggggacgtaagggaagaataatrattatctggctgtgtttttgtttaaaaaaaaaaaaaaactggtgtaaatctccatagacttcctatcctcgctcccttcacccacccacgcgctcccaagatgcaataagcaaataaaaagactaataacgctgtactgcaggtcgactcaggagctggagatgcgtcttggtgggaggtggtgggtgggagtaggggggtttagggaatggatctgaacattgaccagcccagagactctaagcagcctcaaaagcaaagggaaagtgggggaacaagcacacattaccaacagagct

SEQ ID NO: 456 - DNA, 599 bp, Homo sapiens
gcctgtaatcccaacactttgggaggccgaagcaggcggatcacaaggtcaggagatcgagaccatcctggctaacacagtgaaaccccgtctctaccagaaatactaaaaattagccaggcatggtggtgggcacctgtagtcccagccacttgggaggtgaggcaggagaatggcttgaacccaggaggcggaggttgcagtgagccgagattgtgctattacactctagcctgggcgacaagaacaaaactctgtctcaaaaaaaaaaaaaaggaagaaacagtgacttggaacatkaaaaatgttatataaccatgagctatcactgtcattcatagggttgtggtagatgtgaaatgacatgatgtacataaaactcatcacttactattatattattacaatattttaagagatgtcctgccttcactgaaaactgtccagtgccttcccatctcactcagaatttaaaaaaaaaaatcaaaagcctggttaccgggactgtcgggaaatagggatgaggatatatatatatatatatatatttttttttttttttttttgagatggagtttcgctcttgttgcccaggctgg

SEQ ID NO: 457 - DNA, 599 bp, Homo sapiens
ccgcaactcatgcccaccctaaggctctgagtaaaccccactctttccccatttgaaattctctccccacttgccttcctctctctctccattcccacctggcttctttctcctgggaggcttcaagcagaccagcctcagcagaagcagctcagactggtgggtgggcctggcaggctaagaaggagaggaggggctgggccagagagtcctcccattcctgccccctcccacaagcctcctccttagctccagcagggtcagctcagtagggtcaagtcccactaccctcatccccaycccagcaaagggctccctagaagtatctttccaaccctctgaggcccctatttctggactccccagatcagaagctatgagctctgtaacaccaccagtacccccttgaacccaaaacagactaggggagagttagggggcagggagagaaccagctgcagggaacaaagcagttcaggttatgggagaaaaagcaagatcagctgaggaaagctagaagggcaagtcgtcacaaaggggcaggggggcagcccagggcaccaaggggaaaactgcccccctctcttcatgacatttgt

SEQ ID NO: 458 - DNA, 599 bp, Homo sapiens
ggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcmtgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttgggga

SEQ ID NO: 459 - DNA, 599 bp, Homo sapiens
ctccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtytccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagct

SEQ ID NO: 460 - DNA, 599 bp, Homo sapiens
gctacacgctgtcgcctggccaaggagggctttattcgtctgagtagttgtcagtcataaccaaagccataagcaatttgctcgggactacctatagacctcgcccactataagcccctttctttccttcgcttcctcttttagagaatgtccggattgctattggactttggagcgtatggctccaaatcaactcattggctaaaacttgacggaaaatggtggttaggtaaaacgcgcctgcgcagcacgcggcgggacgggggtgggccaatcctgtgagggtttaaccttctcttkttccacctcttcacccctatcttgtcgccatggtgactgctctacaattggcgaggcttgcacttcaaagtcctaggctcgcttcatccgggtccttcagctgtggactttctgctgattgggccttttccttttcccctgattggccgacatcgggaaagacggcgaagagctaggaaaagagggaaaacactagggtcgcagggttcaaaatggctccaacctcctttggtgacgtagagagcagaacttgggtctgcccctcccttttagttaagggagcagaactgggattagcc

SEQ ID NO: 461 - DNA, 599 bp, Homo sapiens
ggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccgtaagaattccagggtcttctccaaggcctccctcttacctaagaaaaagccttcaaccccagccttggcccatgagggcctctgacttccactggcctcatttccacayacagagtttgagaaccttcacaattacagcctctgactggatttttcctccttcagagattcctgggaagccagaaattgtagattctgcctctgaactcacggctggtgttcccaataaggtagtggaagaaagcaggagaagtagaaaacggccctgtgaacaggaggcgagtgtgtgtgggtgtgggtgtgtggcatctctcattttcaaaggattctgaggtcaccactctttccccaggtggggacatgtgtgtcagagggaagctaccctgcagggactcttagctggcactt

SEQ ID NO: 462 - DNA, 599 bp, Homo sapiens
ggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagttccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatggg

SEQ ID NO: 463 - DNA, 599 bp, Homo sapiens
cttgaggctggagccaaccccaaccagccagaccgggcagggcgcacaccccttcatgctgctgtggctgctgatgctcgggaggtctgccaggttagcacacactgaggtccctacagggaatggggcgagcttacaagtaaagctggacagaagcatcccctagagtttgacaaggaggaaattggtgtgattgggaacctgacagggaaactgcggaggatggctgaatatggattgcgagtggggttaatagtgtaaggaactcgagttggcagtccaaggtaccccaggggtcastggccctctgtctccccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatggggtatgtagaggaaggggtgatgtatgctatagagaagttgagcagatggggtgggagatagcgtgcaaaatataggtgcagcagaggggcattccctctcatcctgctgttacggcggtcaatctgagatgc

SEQ ID NO: 464 - DNA, 599 bp, Homo sapiens
gcctccttgaggctggagccaaccccaaccagccagaccgggcagggcgcacaccccttcatgctgctgtggctgctgatgctcgggaggtctgccaggttagcacacactgaggtccctacagggaatggggcgagcttacaagtaaagctggacagaagcatcccctagagtttgacaaggaggaaattggtgtgattgggaacctgacagggaaactgcggaggatggctgaatatggattgcgagtggggttaatagtgtaaggaactcgagttggcagtccaaggtaccccaggkgtcactggccctctgtctccccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatggggtatgtagaggaaggggtgatgtatgctatagagaagttgagcagatggggtgggagatagcgtgcaaaatataggtgcagcagaggggcattccctctcatcctgctgttacggcggtcaatctga

SEQ ID NO: 465 - DNA, 599 bp, Homo sapiens
ggctcaggacatcccaaccatgccccttggaaggtcccggactgtacttccccacagcaaactgctgacatcaggggtgtcaccccatctgttggtaagacagagtaatgggtcaatctaaaggacacaacaagggggaagggacaacatgtaagctcagagagaatcaaaacctgaggtgttgggaagctaagttctggctctgtgtggctttagccaagtgacttttctgcttttctctgacttcagtttcttcctctgtaaaaggaacctgcagcttaattctctgacattccaggrcagtggttttctcttttttttttttttttttctgagacggagtctcgccctgtcacccaggctggagtgcagtggcgcgatctcggctcactgcaagctcctcctcccaggttcacgccattctcctgccttagcctccagagcagctgggactacaggctcccgccaccacgcccggctaattttttgtatttttagtagagacggggtttcactgtgttagccaggatggtctcgatctcctgaccttgtgatccacccgccttggcctcccaaagtgctgggattacaggcgtgag

SEQ ID NO: 466 - DNA, 599 bp, Homo sapiens
ggactgtggggtaaggagagggggactcaggacctccctaaaacctgactcttttcttcaccctagaaagaattccccatattttgtgccctctagggctttggttgctaagtgggggcagctgtggagcaatgagcttagtcaagtcctggatggtagtccagacaccccaatgtctgctaacacccctgtctccctagactgtcccctctctgtaccctcccaagctctcctctgtttctaaaggagagtcccaggcccttttccctctgtgaggtgctgactgctaggggaaatacyccatggcagcaaggcttagggaaggaggcttgagacctgagttccttcaactcttagagaggagcccaaaggccacgccccacattaaatactgatgccaccccattaccctaggttggagtccagagtcttcgacccctgtttagtgatggttattagggtggaaactccctggagcccaaggctgtggccacactgtaactcagagccatctacgtccttcctcctcctctcacccacccctctccttccctggctccagtggatttcaggctcacgtgcaggctggaggggtctca

SEQ ID NO: 467 - DNA, 599 bp, Homo sapiens
ccagcctggacaacaagagcgaaactctgtctcaaaaataataataataataatataatagcattctattaactgtttagtcttctaggacttgcactgtaatgccacagtccatcaggttgttgcacacagctgtgcttcatccattttcaacagaatgtaatatgtcattgtgtgaaattaccacaggacatggtttcaacatccacaaaatgattaacttgatgctctctgaggcgccttttagatatgagaatctaggaccctctgcaccgtcttaacccaagagtttgcttgatrgagagcgggaagaataatgcaagttgcatctccaatatctcccctcccctccacagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcga

SEQ ID NO: 468 - DNA, 599 bp, Homo sapiens
ccacaggcactgcagcctgccactctctggccaatgccttctactgccagtgtctgcctggacacacaggtgaggccccaagacaaggggcacaagtgtgtctggagcacagccaagcagaccatggagagccagatagtctccacccatgcggcagccgtcacctggtccatcccctgcctccacgcccacccccgcccagaaaagatgccccaggatcccttcacctgcacatctagcactgggccaacatccaggaatgagctaggatggaggcagtgactgatgcagtgtgtgacrtctaatctcccccataattacaggccagtggtgtgaggtggagatagacccctgccacagccaaccctgctttcatggagggacctgtgaggccacagcaggatcacccctgggtttcatctgccactgccccaaggcaagtgaccacaaatctgccttctctgttgccccctatgctgacaaggcaagaatacctcagttggaatcccagaagggactgtgggtgagcactgatgtggaaattattggaaaaagccatgccaagctcacagtgggaagtgtctctcagaagcagtcaa

SEQ ID NO: 469 - DNA, 599 bp, Homo sapiens
agtgagccaagattatgccactgcccttcagcctgggggatagagcgactctgtctccaaaaacgagagagaaaaaaaaaaagaaaccaaaaaactcacatgtaccccatagatacgtatgactaccgtttgtcaataacaaaagaaaataaaatggcaaccacacacacaaaaaagttgtggttctgagcatatgaatcaggctgcttagacttgaatgccagctttgcctctcctggcttagtgacctggaccacaaagaagaggccctaatccagcctggggagaagttagggacaycttcctgaagaagatgcctcctgaacaccagcctgtggaagaggggttgggaaggccattccaggtagtgtcaatagcagggataaaggctgagaggcaagaatcagtatggggtacgtggcaaagtcagcagcagtttcatgttgctggagcagagagtagaagggtgggatggggagagctgaggcctgagaggcaggcagggctgggtcatgcaggccttggactttattcagaatgaggcgggcagcctccgaaggttcagcaggggagagacaggtcaactggacattttcagt

SEQ ID NO: 470 - DNA, 599 bp, Homo sapiens
cctgccccgttcctgtgggcttccacacagcttttggccaaaacaaccatctgagaatcaaaaccacacagacaaatcagttcttgattgcagaggtgttgaattgtgcaatcagagaagcctaacacaattcctgttacctcatttaacgcaattcaagcaacaccaaccagcccattccacaggattccagtttaacccaaccatgagggacatgactcaacgtggagcaactcaactctgtcctgatcatcataacccaggcagagtggaccacacttaatccagctacactcaacrcatttcaccccaccccactcacttcgatgtcacgccaccctctttgtaaaagaacactaaaataaggtttgatatgagaagagctcgggaaagagattatgatggagttaagggatagctgatgggaatcacagggagagaacattaaaggaatgcagaactcaggggacagacttaagccacttgtcctcacttgaggcataccttgaattatttcttgctcaagccttgctttaagccaagaaaacagttgctttaacattatgataagctttaggggtatgtctccaatattctgg

SEQ ID NO: 471 - DNA, 599 bp, Homo sapiens
ccagtgtaaatggtgtgattgcggcttgggagcagaggacggggctcaaagaaaaggcattcacttgcttatttagcaagcacttaccaactgcctactatgccagatacggaggcaaatctgagtaagacagttgccatcttcatgtgactttaagtctaatacagagagaccaacaagtctcctgttgatcatagcccacagaggtgctctgagagaaaaacgtgcaggatattacaagagcacagaggaccagccaacccagactaaaaatggaggaggtgatggctgagatgagtyttgaaagataagcagaggctgggcgtggtggctcacgcctatagtcccagcacttcgggaagccgaggcgggtggatcacccgagattaggagttcgagatcagcctggccaacatggtgaaacctcgtctctattaaaaatacaaaaattacactttgggaggccgaggcgggtggatcatgaggtcaggagatcgacactatcctggctaacacggtgaaaccccatctcaactaaaaatacaaaaaaataactgggcgtggtggcgggcgcctatagtcccagctactccagaggc

SEQ ID NO: 472 - DNA, 599 bp, Homo sapiens
gcagaagctctccctgtgccaatggtgggcagtgccaggaccagcctggagccttccactgcaagtgtctcccaggtaaactggggcacacactgtgggggacagcgggagcaggaggcagacatccgtgcaggtccctgaccttcctgctgtgccacaggctttgaagggccacgctgtcaaacagaggtggatgagtgcctgagtgacccatgtcccgttggagccagctgccttgatcttccaggagccttcttttgcctctgcccctctggtttcacaggttcacaggggaggcaytggaaagaactggcagaatattttattccatttgggttggggcagagttcattggtgggtgtttgatggttgggatgtgagaatagaatgagaatggtatcctttaaagttatttagtgtaaaacctgcacaattgtacaaccatggggacaagggcaggggttaccgtagggcccacatgggcccagtgtaaatggtgtgattgcggcttgggagcagaggacggggctcaaagaaaaggcattcacttgcttatttagcaagcacttaccaactgcctactatgccagatacggagg

SEQ ID NO: 473 - DNA, 599 bp, Homo sapiens
ctgacttgccccactcaggcggtcctcccccgaggtgctgtctgcatggggttgaataagatgaaccctgaggccctgctgcttcgcagtgtgtggccctgctccttgaggtgtgaaaggccagggaacagggtgcttgctggggacctgcgggaggactacaaggctttctggtggccattcctgtgtatacagagggcggggctcaccagggcaggctgatcagcctggaggacctcaaggtacaaataggaacaaattggcttggagaatgagtcccgcttcttgttctccctgggygggcctccatgctagggagaacagagatcccaaagtggaggaatttgaagtgcatctgggaagcttgttgctcctatatttgtcccgttgctttgggttcatcctggtctccactgtttcatcctgaattgaggtgggatcaacctctggaccttggcttcctttcttttcttgcctgaggagtctgcttctgaagctccttgatatctacaatgttgtcccttgggttaccgaaccgttttctcttatttctctatgattgtctgttgggtgacctgagccagtatctttgggtgccg

SEQ ID NO: 474 - DNA, 599 bp, Homo sapiens
tttcttttcttgcctgaggagtctgcttctgaagctccttgatatctacaatgttgtcccttgggttaccgaaccgttttctcttatttctctatgattgtctgttgggtgacctgagccagtatctttgggtgccgctcagtttagaaagtcaatatggggtagtggttataattgttgaagcccttggtttgaatctcagctctgccacttgctagctgggtgaccttggacaagtcacttaaactctctgtgcctcagtttcttcagttataaaatgggcagtgctgacctcatagrgttattgtaataagtagatgagacaatgcctgtaagatgctcagacagtacctggcataaagttggcgattatttttctgatttcattcaactccttgatgttggctctgttgctgtctccctggggcgacttttcccccttaaaactagcctggaggtgggtgctgtcttgcagcaatttttttcttgttgtaccaaattttcctgttgtatcacagggcttttgggattttaagggattaccttgaatctctacatgggagagtttctataatcagagggagcattctgggttgacc

SEQ ID NO: 475 - DNA, 599 bp, Homo sapiens
agggttattgtaataagtagatgagacaatgcctgtaagatgctcagacagtacctggcataaagttggcgattatttttctgatttcattcaactccttgatgttggctctgttgctgtctccctggggcgacttttcccccttaaaactagcctggaggtgggtgctgtcttgcagcaatttttttcttgttgtaccaaattttcctgttgtatcacagggcttttgggattttaagggattaccttgaatctctacatgggagagtttctataatcagagggagcattctgggttgrcctgagcaaaggctgcagcacagaaagtttatgaactgctcttctaccctctcttgctgggctgctgtgtacagtggaccaggttgtgcagcctctatgatgactatgaaatgaatggcagcttccccccaagttgaggaatgcataacctcactaccatctgtggtaacccctctcctaggggtcttgggtgtccctgagttttcgtctgggggtagagagagaagcatctgtggtaacttacgccaattggcctgaagctgtccttactctggagggggcattcctagtgggttcag

SEQ ID NO: 476 - DNA, 599 bp, Homo sapiens
aatttttttcttgttgtaccaaattttcctgttgtatcacagggcttttgggattttaagggattaccttgaatctctacatgggagagtttctataatcagagggagcattctgggttgacctgagcaaaggctgcagcacagaaagtttatgaactgctcttctaccctctcttgctgggctgctgtgtacagtggaccaggttgtgcagcctctatgatgactatgaaatgaatggcagcttccccccaagttgaggaatgcataacctcactaccatctgtggtaacccctctccyaggggtcttgggtgtccctgagttttcgtctgggggtagagagagaagcatctgtggtaacttacgccaattggcctgaagctgtccttactctggagggggcattcctagtgggttcaggactagttccctgttttccccacccaaggccccatccagctgatacctggcgggcagaggcagtggaaggtggcaagtaggtccagacaggtgcttcctgggtggcagggctgggagaggcactcattgtgatcagcctcacaacgggagcctgtgtagccaggtggacagaggcagtt

SEQ ID NO: 477 - DNA, 599 bp, Homo sapiens
gtgccatggggatgcccaatgcagcaccaaccccctcacaggctccacactctgcctgtgtcagcctggctattcggggcccacctgccaccaggacctggacgagtgtctgatgggtgaggccactcccacttcagagcctctctgagcctcagacaggcctctgcactgaagacagaaaagggcagattgcttttccaattaaaaaaccaaacatctttttccttgaatttgcccagatttggcatctcttgcctacatgaccctctctccaatgttcagcccctcagtccccatgartttggtcccttatttcctttccatcttaaagacacaagccccttccccaatttggtctcgtctgccacacgcaggcccccacaccttccctgacagtctcacctccttgcccttcctgccctgacccctgtggactcccagctcttctctcctcccagcccagcaaggcccaagtccctgtgaacatggcggttcctgcctcaacactcctggctccttcaactgcctctgtccacctggctacacaggctcccgttgtgaggctgatcacaatgagtgcctctcccagccctgccacc

SEQ ID NO: 478 - DNA, 599 bp, Homo sapiens
aaaagatgtttggttttttaattggaaaagcaatctgcccttttctgtcttcagtgcagaggcctgtctgaggctcagagaggctctgaagtgggagtggcctcacccatcagacactcgtccaggtcctggtggcaggtgggccccgaatagccaggctgacacaggcagagtgtggagcctgtgagggggttggtgctgcattgggcatccccatggcacggctggctcagacacatgtcttccaagtggcacaggagtcctggaggggtaagagggggtgaggctctcaaaggccayttgaagctcctagcagtcctcctggtgcttctctcaccctccttctctacctcccacctcctgataccctctacccccatacctgtgcgtccaggtgggcagaggcaggagaaagagcccacccggtcaatgcaggtggatcccggggcacaggtggcagcaatacagtcatccaggttctcctcacagcttgtgccgccccagccactcacacacacgcagtgaaagctaccagcagagttctggcaggtgcccccgtttctgcagtgagggggaccctgggtctcacactcatccac

SEQ ID NO: 479 - DNA, 599 bp, Homo sapiens
aatgggggcacttgccaggatgggctggacacctacacctgcctctgcccagaaacctggacaggtgagttgtttaagccacatccatgacacccatggcccagagagttggcccctggcctcccctactcatagggctcccagccttagccctcgtcccctccccaaccccctgcaggctgggactgctccgaagatgtggatgagtgtgagacccagggtccccctcactgcagaaacgggggcacctgccagaactctgctggtagctttcactgcgtgtgtgtgagtggctggggsggcacaagctgtgaggagaacctggatgactgtattgctgccacctgtgccccgggatccacctgcattgaccgggtgggctctttctcctgcctctgcccacctggacgcacaggtatgggggtagagggtatcaggaggtgggaggtagagaaggagggtgagagaagcaccaggaggactgctaggagcttcaagtggcctttgagagcctcaccccctcttacccctccaggactcctgtgccacttggaagacatgtgtctgagccagccgtgccatggggatgcccaatgcag

SEQ ID NO: 480 - DNA, 599 bp, Homo sapiens
cccacagctgatccatgaccctgtcaggtttcataggcccagactgtgaggtgaatccagacaactgtgtcagccaccagtgtcagaatgggggcacttgccaggatgggctggacacctacacctgcctctgcccagaaacctggacaggtgagttgtttaagccacatccatgacacccatggcccagagagttggcccctggcctcccctactcatagggctcccagccttagccctcgtcccctccccaaccccctgcaggctgggactgctccgaagatgtggatgagtgtgagrcccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggtatgggggtagagggtatcaggaggtgggaggtagagaaggagggtgagagaagcaccaggaggactgctaggagcttcaagtggcctttgagagcc

SEQ ID NO: 481 - DNA, 599 bp, Homo sapiens
  misc_feature (300)..(300): n is any nucleotide
ttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtgtgtcctcacaggggctctccggccgcccctctctctgggcagggcaggatgtctccgttggagcctcctcccacagctgatccatgaccctgtcaggtttcataggcccagactgtgaggtgaatccagacaactgtgtcagccaccantgtcagaatgggggcacttgccaggatgggctggacacctacacctgcctctgcccagaaacctggacaggtgagttgtttaagccacatccatgacacccatggcccagagagttggcccctggcctcccctactcatagggctcccagccttagccctcgtcccctccccaaccccctgcaggctgggactgctccgaagatgtggatgagtgtgagacccagggtccccctcactgcagaaacgggggcacctgccagaactctgctggtagctttcactgcgtgtgtgtgagtgg

SEQ ID NO: 482 - DNA, 599 bp, Homo sapiens
ccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtgtgtcctcacaggggctctccggccgcccctctctctgggcagggcaggatgtctccgttggagcctcctcccacagctgatccatgaccctgtcaggtttcataggcccagrctgtgaggtgaatccagacaactgtgtcagccaccagtgtcagaatgggggcacttgccaggatgggctggacacctacacctgcctctgcccagaaacctggacaggtgagttgtttaagccacatccatgacacccatggcccagagagttggcccctggcctcccctactcatagggctcccagccttagccctcgtcccctccccaaccccctgcaggctgggactgctccgaagatgtggatgagtgtgagacccagggtccccctcactgcagaaacgggggcacctgccaga

SEQ ID NO: 483 - DNA, 599 bp, Homo sapiens
caatactctcatcatcactttagaagatatggtcactccagataaaccctcccaagccatgacatcgctcagagcaggggtgatggaacagagcaaagaaagtatggtaataaagggaaggaaatatgaaaatgagacccagagataatccagagtgagcactgggtaacctcagatgggctagaattcgtacaatgctagaaacggctccctctgtcctctgcctcaggtgagcagtgccagcttcgggacttctgttcagccaacccatgtgttaatggaggggtgtgtctggccacrtacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtgtgtcctcacaggggctctc

SEQ ID NO: 484 - DNA, 599 bp, Homo sapiens
tcattctaggggctctgcaccagcccctggatccaaatgctagctctgccactgatcagctacatgacctcatataagatattttagctttctggtgttcagttgtcagctgacaaacagggagagtaatggtcacacttcataaggttgctgagaggacagaaggggccgatgctcaggagatgcttgctcagctcagcacctggcacctccactgctgccgccattaccactggtgcacatggactgtgaagtgagtctccaggtgcctaaacccacttaaagattaggaaatgaggwtcagaaaggcaaagtggctcacccaagggtatacaaccagttgtggcacagcatggtgccacctgagtctcctgcctgcagacgtggggtgcttttcacctcccccaagatcacccacgtcccagattttctcaggcaaggccaatttgcaatactctcatcatcactttagaagatatggtcactccagataaaccctcccaagccatgacatcgctcagagcaggggtgatggaacagagcaaagaaagtatggtaataaagggaaggaaatatgaaaatgagacccagagataatc

SEQ ID NO: 485 - DNA, 599 bp, Homo sapiens
gcctgctgccttcaaacagtgccagcctgtgcctgtgcggagctacagcccagaacaaaaccaggagcgcatcctgaatgcggccaataaactattagcagaaaaagaacaaggagcaaacgtgtgaaccttgatatgctaggaagaggccatattgtattagctttccagtagcagtcccaaaggcaggaaaaactgaaggatgtatatttagatctcttgaaatcgggctacttctactaggtattctatagccaagcaaactgtaggtgtacctagcaatattcttattgtcatcargattaacttgtgattcaagattttattttattattattattattattttattttttaatttatttttttgagacggagtctcactctgtcgcccaggctggagtgcagtggtgcaatctcggctcactgcaagctccgcctcctgggttcatgccattctcctgcctcagtctcccaagtagctgggactacaggcgcccgccaccacgcccagctaattttttgtatttttagtagagacggggtttcatcgtattagccaggatggtctcgatctcctgacctcgtgatccacccac

SEQ ID NO: 486 - DNA, 599 bp, Homo sapiens
ctcgatctcctgacctcgtgatccacccacctcagcctcccaaagtgctgggattacaggcgtgaaccaccacacctggccccaacttaagattttaattgactctctggagcaggcaggtgtctttgatttgatggggctgtttaagtctgcgtcactattgtgctgccagtcgcccaccctggggagtggaacttgcctgcagtagcaccgttctggtgttgaagacaggaagcagggtgagggaaccctgtgggtggaggggatttcccagacaaggatcagaaagacaaagcccaygatgtcactggaatcgattgtgctgctgagtggaagatttctataaactataggtttgctccaactctgtgcctgccccccaaccccaacacctaattacctgctttatccaggagtttgcacaacatccacgcagtcactgaagtcagctcactgggcttggctatcacagtgttccctgcagccatcgctggagctatcttccaggtcagcaagtagagtggcaaattccaggggctgatcagaccagctaagggatgagagcagaagcactgcctgtgacggcatacccctctgag

SEQ ID NO: 487 - DNA, 599 bp, Homo sapiens
ggtgcagtggctaatgcctgtaaagtcccagcactttgggaggctgaggagagtagatcaccttaggtcaggagtttgagaaactccgtctctactaaaaatacaaaaattagttgggaatggtggcatgtgtctgtaatcccagctactcgggagactgaggcaggagaattgcttgaacctgggaggcggggattgccgtgaaccaagatcacgccactgcactccagcctgggcgacagagccagactccgtctcaaaaaaaaaaaaaaagaaagaaaagaaattacttagacagakagtgagggtatagaagacctcggtaaggttttcctttaaatgaaaagcagccccaagtcattttgcttactaacaaagagcagcctgtaaaatcgagctgcagacatacaagctggcagttgttgtcaattgtgttcaaaatggcgactccatcttcccttcttggccagccaggtgtacaggaaggagcaaacaaagtggcaccggacaaggggaaagttcatttgcataataagattagggtggggcggccagccttctcctgagctatgtaaacctagtacctgattcaaccaatc

SEQ ID NO: 488 - DNA, 599 bp, Homo sapiens
tctcagccctggacctaggagtattggcttgatgaattctgaactccttgtatagagctgttgccttgtgatttactcattctacttagggaaaagaacctttcaggggcacactgatgtttagggaggaagtgtcccacaaggagagagatttttaaattctttatgtgccttaatataggcactctagaataaggggtaaatcaggaattcggaaataacctgtatcatggtaagcctattagtaggactgatttctggtatccttcatgtcatggcaaatttccagtatttagcatrtctctcaaagaacctaagaagagtacttcatttaccaatagaagcagtggctgcagaaaactttgtcatgaagaaatgcatgggaaggctcctttgttttgcctcctatcaaaaagcaacttggtgcaaggcaaagaatatctatctataatttaggaacgcttcaggttagcaatcaactaactgtgtcaaggcaactcactttgccagcctctgtttgtttgtttgtttgcttttaaacaggttttaccacaggacctctaagtttctttccggtttaatttttttttttttttttt

SEQ ID NO: 489 - DNA, 599 bp, Homo sapiens
tttagatataaaagatgattagcttttctcacaactttcatgcaaacataactaaaaattaacactattgatttttgctaaataaaagtaccaaaaacctgttatctacatgacttgtttgcttaaaagcatttgccttgggaggcaattacttttgcaccaacctaaaaacatccaccaaagcgtttggggcttcccagagcctccatgttagcaaatcttgggctaacatgaagaggatgtgatgttgttggatatggccaataccatatgaagctaagtctagctgagtgttagccygggggatactgccaggaacaaatgaggcccagctcccagtaatgggatatgtgtctcctggatgcactctgaggattaaattccgtgcgctgacacacactaaagcctctagcaaagtcttcatttaattaactacaaacttagatatatgaaacaaaacctctgtaaaaaatcttaaggtcgagaacatactatataataggcacaagactgaagcagtgtggggcagatgtgatgatagagtctttgatgttgatagaaaagcaaactggaaaatattcattcgtcctccagaacct

SEQ ID NO: 490 - DNA, 599 bp, Homo sapiens
tctaactgatggaacaaatggaactgcaacctagttctccagatttctaatctagcccgtccagacactcattgttattcttctcctctatggtaaccggagcaaattgaataacttttacatccatttaatggcaccatcatggtttcagtgcatatcatttttaagttctggttttaggctcggttgtgaaaataattttgtgatgttgcagaagaacaaagcaatttggttttcccgattaagaaactctactgacacaacatcaggattaaattcactctggacagcagatgttaytatatcaaaaccacaaaatgttatcagggcggttccctcagaagacacttactggcaaaaacttctggcatttactattgaaaaaattaacatttttctcttataagagtttatggtagaaaattcagaaaatacaaagaaaaaaaagagtaaaatagaagtctccagaaataccatcactgagaaaagcataagcctggggtgggtttggggtgggagaagaaataatggaattatattggattatatgcaatatttgtaatttgtgttctgcttctacaatagacatttttcatgtc

SEQ ID NO: 491 - DNA, 599 bp, Homo sapiens
tctggacagcagatgttactatatcaaaaccacaaaatgttatcagggcggttccctcagaagacacttactggcaaaaacttctggcatttactattgaaaaaattaacatttttctcttataagagtttatggtagaaaattcagaaaatacaaagaaaaaaaagagtaaaatagaagtctccagaaataccatcactgagaaaagcataagcctggggtgggtttggggtgggagaagaaataatggaattatattggattatatgcaatatttgtaatttgtgttctgcttctacratagacatttttcatgtcattagatattttgtacaacatcaccttaaaaggcggtattgtatggatatacaataatgtaattaactgaacatatggttatttacagttttttcacaagcaaccctgctgtatttctgtgcacagatatagttaaaatcttgggataagttctgaaagtggaatcacttgaacaaatgtttttaatgcttgccaaagtgcttctggcagtgaattaaccttgtaacaataaatagtattactgaaaacaatcttagtccatttgttattgttttacttta

SEQ ID NO: 492 - DNA, 599 bp, Homo sapiens
aaattaacatttttctcttataagagtttatggtagaaaattcagaaaatacaaagaaaaaaaagagtaaaatagaagtctccagaaataccatcactgagaaaagcataagcctggggtgggtttggggtgggagaagaaataatggaattatattggattatatgcaatatttgtaatttgtgttctgcttctacaatagacatttttcatgtcattagatattttgtacaacatcaccttaaaaggcggtattgtatggatatacaataatgtaattaactgaacatatggttattyacagttttttcacaagcaaccctgctgtatttctgtgcacagatatagttaaaatcttgggataagttctgaaagtggaatcacttgaacaaatgtttttaatgcttgccaaagtgcttctggcagtgaattaaccttgtaacaataaatagtattactgaaaacaatcttagtccatttgttattgttttactttaaatggtatcttgccaggtttttaaaactctgtatttcttttgttactaatgatactcaaattttaaaatatatttatcttttattttactttcttttgtgaa

SEQ ID NO: 493 - DNA, 599 bp, Homo sapiens
acttcatcatttttatactgggcatttttcattattcatttctgtggattgttatgtagtactcctttgttatacatgtagcaatgtctttatcagtcttttttcttttgatttttattttttactaatttatttttgtttgtctttgcttttttttttttggagacagagtcttgctgtgtcacccaggctggagtgcagtggcacaatctcatctcactgcaacctccgcttccagggttcaagcaattctcgtgcctcagcctcctgggtagctgagattacaggcgcatgcaaccrcacccgactaattttttgtgttttagtagatacgatgtttcaccgtgttgctcaggttgctctcgaactcctgagctcaggcaatccacctgcctcagtctcctaaagcatgattacaggtgtgagctactacacatgggcagattcttaatttttcatgttttaacataaaacagctctcaaagttttaagctttatgtaaactaatctgctacctttggcaccaaacttagaaattctcactctacctgaatattgtaaaaatattaacaattattctctggtactcaaaggtttta

SEQ ID NO: 494 - DNA, 599 bp, Homo sapiens
gtttcaccacgttggccaggctggtctcgagctcctaacctcaggtgatccacccactttggccttccaaagtgctgggattacaggcgtgagccaccgcactgggtcaagggtgtctcttgatagcggtgggaaaagtcatgaaaaattcctcaagagtagcagctcctaaaattatcttagaacccagattgagacaaaaggctgcaaggacttgccatctcacagattgccaggctgtcttgcattgtgagcccatggatgggatctacctctggctgattggggtaggccataggwcaggacatttaacatccccaaaggaccctgcagaacaagatttgtcagccaggactgcaccagcccagattaagcttactctctttctcttccttcatctctttgtccctacaccacagaaaagtggattgaaagaatgaaactatcctcaaacattagctcataagggaaagaacaaatatgtctcagaggtaagttaaaatagagttagggagaacaagccacactatattatagaaagcagaattttgaactaagctttaattcaatttccagttaaattcagtataaacaagagg

SEQ ID NO: 495 - DNA, 599 bp, Homo sapiens
tcatcagagtttcccaaaatgaaactctgtatccattaaacagtaactccccagatctccctctgcagcccttattaaccactattctttttgtctctatggatttgcgtgttctagatccctcatataaatggaatcattcactatttgcccttttgcatctggcttatttcacttagcacaatgttttcaaagttcgtccatgttgtagcatgtattaattttatttctttttaagatggaataatttttcactgtatgtatacacattttgtttatccatatgtttatccatttgtycatgaacatttggtttatttctaccttttgattactctgaatattggtgtacaaatatctgttctagttcctgctttcaattcttttgggtatagatctagaagtggaattgctgggtcatatggtaattctatatttaatttttttgagaaattgtcacaccatttttccaaagcagctgcacccttttacatttccataagcaatgcacaagggtttcaatttctccacttcttctccaacactttacaaaatatatacaatgagcattctaataggtgtgatgtaatatctcattg

SEQ ID NO: 496 - DNA, 599 bp, Homo sapiens
agtttgaagttggccagagcacacttgaatgacagaatccaaggaacctaggaggatatgacagcatctgctatgtttgaatacctactttgtcccaggtattattctaagtgttgggatataggccatagacaaaaatccaagctcatgaagtctatatattctggctgggggagacaaatgataaacaaacatatagcaaaagatggtaagtactataaaaaagtaaagctggttatgggaatagagagtgatgggggtaagaaggaaaccagtttagaaagcgtggctggggaaagwctctttgtaaagtgatacatgagcagagaactgagtaagtgagggagataacctagtaagtatctggggacagggagatccagagagaagagtaagttcgaaggccctcagataagagtgtcccagcatgtttagaaaagagtaaggaggctaatgttactggctagattatagggagaaagaaaaaaatggcagctggtgaagtcagaatattgggtagcagtgagatcctgtagggctttgtagaccacaataagaacgtgttgttttattatattatggtgttatattatattgca

SEQ ID NO: 497 - DNA, 599 bp, Homo sapiens
agagcacacttgaatgacagaatccaaggaacctaggaggatatgacagcatctgctatgtttgaatacctactttgtcccaggtattattctaagtgttgggatataggccatagacaaaaatccaagctcatgaagtctatatattctggctgggggagacaaatgataaacaaacatatagcaaaagatggtaagtactataaaaaagtaaagctggttatgggaatagagagtgatgggggtaagaaggaaaccagtttagaaagcgtggctggggaaagactctttgtaaagtgrtacatgagcagagaactgagtaagtgagggagataacctagtaagtatctggggacagggagatccagagagaagagtaagttcgaaggccctcagataagagtgtcccagcatgtttagaaaagagtaaggaggctaatgttactggctagattatagggagaaagaaaaaaatggcagctggtgaagtcagaatattgggtagcagtgagatcctgtagggctttgtagaccacaataagaacgtgttgttttattatattatggtgttatattatattgcaagatagatagaaaga

SEQ ID NO: 498 - DNA, 599 bp, Homo sapiens
atattatattgcaagatagatagaaagaaagtggaggcttttgagcagagaagcaatttgatctgtgatgttgccagtcaaaattggtgattgccatattgtttctgttcttcactctaaaacaccaaaaatagtaaagcaaacacatgatcacccatccattcatccatacattgagaaagcctttcagagttgagtaattccggctccctttctgctactgccatctgggacaagctgctgtggggaggtagtaactgggaggtagctcatatgaagaagacaggcagaatgagaaamaaagacgaacaatgttggccaacccaatgatcaccactcttcattttttttctttttctttccttttcatttcttttctttgaatctctaccttaaagaactacacatagtccttcacatcagaaggtgacactatagttcttgacagacagaagatattcaagaaatattaatgaactcctaaaatctgtgttaatttatggcatgtaactggtgcagggttaaaaaaaaaaagaccaataatgacataaaatgcacattaacataagcagcagaatatacacaggttaaaccaaaca

SEQ ID NO: 499 - DNA, 599 bp, Homo sapiens
atagatagaaagaaagtggaggcttttgagcagagaagcaatttgatctgtgatgttgccagtcaaaattggtgattgccatattgtttctgttcttcactctaaaacaccaaaaatagtaaagcaaacacatgatcacccatccattcatccatacattgagaaagcctttcagagttgagtaattccggctccctttctgctactgccatctgggacaagctgctgtggggaggtagtaactgggaggtagctcatatgaagaagacaggcagaatgagaaacaaagacgaacaatgytggccaacccaatgatcaccactcttcattttttttctttttctttccttttcatttcttttctttgaatctctaccttaaagaactacacatagtccttcacatcagaaggtgacactatagttcttgacagacagaagatattcaagaaatattaatgaactcctaaaatctgtgttaatttatggcatgtaactggtgcagggttaaaaaaaaaaagaccaataatgacataaaatgcacattaacataagcagcagaatatacacaggttaaaccaaacaatcacacaggggatt

SEQ ID NO: 500 - DNA, 599 bp, Homo sapiens
cctcttttgctaggaggttggactatcgtgctcgttgaaaatgggggcgaggaatcaggagacagagttgaggtttccccctattgcattgtaaggtatctgtagaatgttctatagacaccttttcaattcaattccttgttccaggaagaacaagaagcatttccaccaggagagctacatcctgaaaacgttaaattttcatggtgcagagtggaataaaagaaaaaaccgacttcaattctctattccatctgtgagaagagagcagagaagtttaaagtgtgtgaccttgagacrgatttttcttttctgttctctgtcatccgactaaaagcaggaaagcagaggagtcatctctacacctctggaaaagagcacccattgtgacaatgacaaagggcagttttgtccatcgcaaacacgggcctcggggcagcagttctggtgaaggggaaaggagaagccccagaaagcttcatggtcacgccacgtatgggatgctcggcagctgccctggctgggatctaacaacaggaagccagcggacctcacggggccattcccaggcttagattgaagggagtaagttggggagt

SEQ ID NO: 501 - DNA, 599 bp, Homo sapiens
tccagaagataattaaaaaattcacggagaaattatgcaaaaatacgtaataaatgatgggggaaaatcacaatcactggaccttgcattactatagaggaaaacataagctttactaatgaaaataatatgatatgggcattgaagtggacataaaaagagaaaataattggtaaccaagaattcaaccttacttgtatagaaatatggtaatttaaatctaagggagaaaggtaataaatgttattgggaaatttagaaaatgatttggaaaagaacaaattgaataagacatggttyctccgctaaagaagtaaagggtttagtcaacgcataccacatttcctcattttcttatctctcgtgacacgcacactattttcgggaggaaaccaaggacttttttcccaatctcttttctttattcccaagaaaattagtagttccaagaccatggagacagtaagcttaatgatgcatatttgaggtggatttttctgcaccttattaaacaaatgctgcttatttttgctttttataaagactctgatttattgtttctagtatttgataaaaagaaaatgttttattgctatttg

SEQ ID NO: 502 - DNA, 599 bp, Homo sapiens
tgagttcttgattgtttaccagtaaatgttatttttcatatctgttgagataattatatatattttctttttatagatttggtcttaatagcttttctacgaggttgtaaacgttattcccaaagaggtttataactggcactttttcttctttcacagatctaagttcgggaaaacaattggtacaggatgtgcagcttgaagaagctgaggggatgagtatactaaatatgccacactgtctgcaccatgccaggtagtctagtatgtattgggttccattgagactgatgctgcatygaattctgatgatacagttcgctgcgcttgtccactctggtctgtaggagaattgccacagtcttatgaatataaggctgggtttggagggggtcagttgaaattttaggagttttcatatgactcttactctttcagatttgctatctgcaattgcacatctgccagtgacctctgtctgttactgaagaaggctgctggcttctttgctgtatatcctgatcacgctgacttccttctgcaacttctagataagtaaatttttttgatttatcaggaagtgtctttggtctctcagt

SEQ ID NO: 503 - DNA, 599 bp, Homo sapiens
tgcttatggcttttggatgtacaatttaagccaaaacaggatgggttacattggtgaagtttactttttgcttctgaaataacatctagaatgttagtttgtagaataaacattttctaagaatttttttacattttttacctgtaaatgcaactctttttacaattcttcatttcctttggaaggagtccaaaactacttacctggaagaccttccaccaccccctgagtatgaattggccccgtccaagttagaagaggaagtggatgatgtctttctcattcgagctcaaggactgycctggtcatgcactatggaagatgtgcttaactttttttcaggtatattttatgtatgttttatttatttattttttttccttatattgtttctcacaagcaggtatgtatgttttaagtatgtaattttgtctgagtaaaaggtagtgctacaaatccatgtcagactacgctgtcaccttcctttttgatggttgggaactgtctcattctggttggttgcatataccaaatgataccatgtgtgctgtttgcggtatgtaacgaattgaaagactttgggccaggggcagtggctc

SEQ ID NO: 504 - DNA, 599 bp, Homo sapiens
gtactctacacatgtgtcaacaatttaatgtacactatgatacaagaagataaagataaaagaagaaaatatttatacatttctttacaactaaaaagcctttctaaaccaagtctcaaaatctggaagccaagaattaaaaaaaaaaaaaaaaaagactgatcaagtagactgcataaaaatggaaaaatgcaacatggcaaaagacaccacaaacaactgtacagacaaatgacaaattgagataaagcatttgaaattcgtagcagaagcaatactctaaaagcccctccataccayccctaatactttaaaagccgctagaaattgagaagaaaaaaaaaaaacctgaaagaaaaactattgttcacagaaaagaaaatacagatggccctaacatatgaaaaaaatgtccaaccttgtttataacaagagaaacacacattaaaactacactaagataacattgttcgcctgacagatttgcaaagtttccaccagcaagttgggggagaagtcctattcagggtaggtgtgcaaagcagagcaaccaccataaagggcaatttggccagatataagaaactgcaagctgcacc

SEQ ID NO: 505 - DNA, 599 bp, Homo sapiens
gaagaaaaaaaaaaaacctgaaagaaaaactattgttcacagaaaagaaaatacagatggccctaacatatgaaaaaaatgtccaaccttgtttataacaagagaaacacacattaaaactacactaagataacattgttcgcctgacagatttgcaaagtttccaccagcaagttgggggagaagtcctattcagggtaggtgtgcaaagcagagcaaccaccataaagggcaatttggccagatataagaaactgcaagctgcaccctacttctgcagtgttttctcacaaatacacyggcctgtatataaaattctgtatttacaaggctgtccactacattattatttattatagaaaaaaattaaatgggacaggcagaattcagaagagaactgctaaactcagttatagtcaatgcagacaatggaaaagcaggctattacaaaagcaagtgaggaagctttccttatatttgtgtggaaagatcttcagaatacatggttaagtggaaaataggcaaggtgaggatgaagtgtatagtatgctacccgtactggtattaatatcaatcagatatggaaataaccacttcac

SEQ ID NO: 506 - DNA, 599 bp, Homo sapiens
gaagaaatgagtaggcactgccaggcaagtctaagaaaacagaccacaaccacttgctttttgaaccttgtctttcccataaagaaatttacaaaaagaaaaagaggatcacaaaatataaaatactcccagaagtctagtccaaaaatgtctatcaaaattaaacttttttttcccttcagacttgtaagggcaaaagtaaagcagataatccatgtgagttctagatcataataaacaaaaattcaaatgggcaatttatttttctaagtgacaagtaagtatagatctactaaatayaggatttgtggtcattgctatatgtaggtagggaccagatgcttggtcacaagggataccgaatgagagtgaaaagccacttctactattcagacactcaaaagcatgtggcatttgctgtttataaaatgtttttcccttgtgtgaaatatttctgaaccgtggtctccagggcacgcacgttgcgctgttttttcctggagtcgtgtttcgtttgcacaaactaacccacattttcttctgtgattcttcatatgactaatgaagcacagctctgaggttatgatttagaggaatat

SEQ ID NO: 507 - DNA, 599 bp, Homo sapiens
tttccaacaaacttaaacaggacttttaggacctggtgatgactctgttatattttaaagtataattcatccccaggaaatctatgaatcacatagagttggcccccagagataagttgtctacactttgaaaaattattttttatctctgtatgctcttaaattgggagaattctggttaattgatcagaagttagggagctttcaatacatgctgttttcacctcaccacaccactgcatacaatgaattccacaagctcggacatattagggagcatttgctataaagtggccccargaatctacacatttctaatggtaaacagttgagataatccaatatctttgcccaacacaatgggttggaacaacctgtcacataagacaaacttccacttctaatgaagataaaactgcgcttattctttcattcgttctttaggcaaagttccttcccgtctcatctgtgccttgccctccaccctctgctctcaccacaaagccctacttgtgccttctgataatcctcatccactctcccttctctaaccacttaacctcttcaccttcaagccattttctccctccctcaattct

SEQ ID NO: 508 - DNA, 599 bp, Homo sapiens
gagtcctgcaagtgctaagtgggccagctgaactgcaaacccaggtgatctagctccatagcctctatattgtacatcatgtagactcaggccactctcacagtataggggctacattcaagatggtcctgcagatgctttgacttcgtaaatgagcctagtattctcagggagtgctgcccgcctgtccctaccttttgggagaaaggtcatgaagtaaattgttatgactccttggcccacatcgctggactcgttgcattggaagggacctggcctgcataagtgtcgaatctctawcagtggtaccattaacctcttaacaaacatctattctgtgtggagtactgtttcaggttctaagcatttcaactaatcagagatggccatgatacttaccctcgagagttagggaaacagcaaatacagaaaaacaggctagggctaggcacaaaattgtcttgtgcaccaaatttaaggttgtggggggtgtgtcataaaaaacaaagtcatccagggaaataatattctaatgaataattttagaaatctgaattaacacacaaaaaatcatgatgaacaaaatattaaaattttaa

SEQ ID NO: 509 - DNA, 599 bp, Homo sapiens
taaaattttaaatgcaggtaagatcagtatcagtgccttcccaaaccatattggagcctgaggcaaaaagaataatcagaggtacccactcctctccctagtcccgccctgtaggaaggaatcaataattcaagatgcatatgtccatttctttggccctcagggccacactcaatcccagaatagaatcaagactctcttttaataacttcagtattaaacttcattcggatgctttatatagcactaaaatggacaattaccatccattcccagcatgatactctcccacagccatcrtgtgggcataaaataatattcagaattgaaataatctaattaaccttatctttaaaaatgggataaaccactattttcttatcgatttttaaaaatctttgagttaaataagaagtaggattacaggtgactgaaaatgtcaagattcagtaatattctgtaaatgaggaaactgaaaatagaatataagcactagcttatatctttatttttatcctattatgataagtgataacaatataactatatgcaataatttaaattttgaaattcccaaactaaatgtaaaaaaaaaaact

SEQ ID NO: 510 - DNA, 599 bp, Homo sapiens
gtagtcccagctactcgggaggctgaggcaggagaattgcttgaacccaggaagcagagatcgtgccactgcactccagcctggcaacagagcgagactccatctcaaaaaaaaaaaaatttttttagagacaagatctccccatgttgcaggtctccacctcactcaagcaatcttcctgtctcaacctcccaaagtgccaggattacagcagtgagccactgcgcctagccctgttttccttcctttatggctgttttagagtttattgagatgagcgttagggctagtattgatgartaatacacatttatattaataaaagattggatagaagatactacctcctttctctcaacccctctcagagattttaccttaaaaaagagggaccaattcaatctagttctaaaaagggaaaactgactttattcatcagtgctgaattcattacaatagggacctctctatccaaaaatcacaagccttcaatttctgccctcatatttagtctcaaggagtgacccactgagtggggaaaataatttcaaaggtgtcacaaaggtaccttttctttcccttttttttttttttttttt

SEQ ID NO: 511 - DNA, 599 bp, Homo sapiens
gttaaactgcttagctatgcatgaaaagtcaagagttgactatatgcagttcaatttaactttctgtaaagaatccattagggactaaagccaggcttcagcaaaaattaaaaagacatttcctgaaaccaataaacatcactcactacagttgctactcagtacaattccctttaccaatagcaattttaacgttcacagagaacttcccatgtgccaaatgctaggctcagtgctagggctgggtgtgcatgctttctcttcattcttataagcccctgtgatttacctgctgtcatygtcctccttttagagttgagaagtgaagtaactagctcaggttgacactttcaaccaaagggagagcagaattgtgaatgaaattatttctctctgattcgctgcacacatttcattgaaaaatacaaaaagttcaggaggaaatgttcagctctgactggccagtggcaggatttggtcatttggccatgttaagtctcgacaatttctctctggaaacccttttagaactatattccatgagggagcttctgctttgtgagaaacctgacaaaagcagcctctttgcttactgacaa

SEQ ID NO: 512 - DNA, 599 bp, Homo sapiens
agagagacaaaaggtgatttgacaaagaccttcaaatgaagttagtctcatcactcctaatccacagttctacttttaaatgaactttcctgctttattacctctgggctggtagagatttgaagattcattttccccttaaggatagttatgtcctagttctaagacctactatgactaaatgctccaagtatgattttagtcattagtttcaacttttgaccctaaactctgtctggacctgtgtaaagccagagaccctacttaaagctccagtgaagaggaggcaagagaacacawccctcctgcggtgcttataactcagctcgtaacttgatgccaggaacattaaaccccactacaaagtcagactcctccatatacaagactgtagatcatcggagtctcatttcagcatgctgaagaaggggctgaattttaatgtagacctaccatctcgcagtatgtgcagctatggcaatgcattgatcctctggtagaaattagagatctctttcctttaagcccattcattaccaggcctcggcgtgtagagagaagggagtggtagagtggtttaggttagacagtggtggcca

SEQ ID NO: 513 - DNA, 599 bp, Homo sapiens
attgatcctctggtagaaattagagatctctttcctttaagcccattcattaccaggcctcggcgtgtagagagaagggagtggtagagtggtttaggttagacagtggtggccaaagcaatgccagtagccatggccatgatgcaggtagacagtgtgtgatagcccagtcacttccttctggcatgaggtcaccccaactttgacccagctctatgcacaaacaagtaaaagtctaaggaagtgttctgttgtgtttattctagctgcgcatgtcaaattgcttttagcaaggctgawtctgtttaatgctgagaatgggaggtggctgacaaccctttttaacagtacagacaattctggctgagtacccagtttacacaattgcatctgtaaacacatgtggtggaggtggtggtaatagacttgtattatggttcgcttagttcctgagtacgtgattaatactaattgtaactacaaacaagtactgaagctactcctctgcagacaaaaaaaaaatatatatatatatatatatatatatttttgtctttaaacccatttattaccaggcttcagtgagtacagagtagtag

SEQ ID NO: 514 - DNA, 599 bp, Homo sapiens
agctttcagttcttcaagtgcaaaaaataaaagcttatgactagaattctgattctctttagtttaatgtgtatttctggggagaggaaaagattaacgttcttataccaaaatcttacacaaggtttcatctttttttggaaatcaacaactacattttaaaagcaaattctttgaactagaagtttctgacttttagcagaaaactacacgatttaatttttaataattataaaatacaatacttagatttgtctccaatctttgtatgtagcaaataacatacttgactatggttcyatcaaattcacatttatggatgaaatagttgtttagaactagatttaaattagttgaacttctttcagcttcattctgtaaggcagaattaggttgattctacaaaatggcacataataagacacgagtgactcctcactttttgggtccaacagtaacttcatgaatctaatgactgctatggaaactctcgcctttaaaaaacgaaaacttgaatatattcattgtattttacataaaattttgtctcctaaagtctactcacagacctaaaatatacattgaatttttaatttgta

SEQ ID NO: 515 - DNA, 599 bp, Homo sapiens
agagaggcagagcaaaactgaaaaagtcctctttccaaggctaccaaatgcaatacacttgctaagatttatcacctacctaatgaggttaattgagatttttttactccagagtctcatgtgggcctattcttgaccaaacccccgctcaaaaactaatgtacaccaagaggtaatggttacaaatggatcaatgtggtcatttaattcaaagcaatggttggaacaggagtctgacaacaccctagggttattaagtgtcagaacaacagggaaagtaactttgctcagggcaatctrctgaaaacacttaacattgtgctgtgcacggtggctcacacctataatcccagcactttgggaggctgaggagacaggatcacttgagcccaggagtttgagcccagcctgggcaaacatagggagaccctgttgctacaaaaaataaaactaattagccaggcatggtggcacacatctgcggtcccagctactcaggaggctgaggtgggagggtcacttgggcccaggaggtcaaggctgcagtgaactgtgattgcgccaccgcactccagcctgggtgacagagcaagaccctg

SEQ ID NO: 516 - DNA, 599 bp, Homo sapiens
gtcataaaataggaagtgatgagttttgaatatttattgtcttttaaaataaaatatatttaactgtaagtttatataatttactttttaataatggctgtgtctaacaattaactcacaaaatttagctcccgtgtattcctgacccagcttgacttcgccagcaggctctgatcccacactctctaccacctgctgaacaactctacccggatgtcttccataagaaaccacaaatttaacataccgaaatctaaacatgctttcctctttgaatctcccagtgcatacttctcttcrcctcttgacttccctatttctattaatggtgcctctaatatccttagcaacccaatcagttgctaagtcttgaaggctctgcctatgttcttctgatctgcctcctccttttcattccacttacggttactgtcctaccccagacaattacctagcctcttccccttgtctcttctcactccaatctatctgacaatactgatagattaatcttccacacacacagctctgataatatagctttgctattcaacgcacatacatgaatccggccttcaaagctctccttgcttcaggca

SEQ ID NO: 517 - DNA, 599 bp, Homo sapiens
gagttcctttgagtaacttaaccagctacgtgaactgccagagacaaactgtcttcagtttctttctatgcatttagagttttatagtttaccaagtcctttgacattcattttacttgatcctaacactggccctgtatgattcattttggaaatggggaaattgaggctggggaaagctaaatgtcttcacccagggctcactgtcaggtggatcctggaagttctcaaccaaataaactctaagatgtcttcaatctctaaaagctatgtagctggtttatctaataaaacacttaygactgatgaaatataatttactcaccatacatttaaagcagaatgttcaatacccactccctcattcttcccgatcaatatattttttgacatattattaccgtccaggcagtagctttgcgatttctgcccatctgttccccagtctcttgtgtgcctggtaaataattctgtcttcctcttctgtccaggaggttttcttaacttctggattcaagtggttatgccacctctccctacattgttttccaattctcccctttaagtgcttggcaataacagaccaacgtttcggaccg

SEQ ID NO: 518 - DNA, 599 bp, Homo sapiens
agtaaaaaggaaagggaacatggagaggagagcagagtcttggccagcaatctattaatcttgtcttctagaatgagtttgctctggaattttctgattctttgatgttgcaaggtgaaataactcatcagtcagcatccactctagcctgagatttcacatcactcccttaagtctgaaataacattcacaaagatttctgcaggagccaaatttggttggtggtgttgtcacagtgaggctctttgggctgtgcggcacctcatgaccatattggctacacccattgtatttgcagcytccaatcagacctttgtctttatttcccttactttgtaatttcagagacactataatgatgaagaccctgagaaggaaaagcgaataaaggaattagaattgctcctaatgtcaaccgagaatgagctaaaaggacagcaggtgctaccagtaagactgtcatcatgtgcttgaatgaggggatagcagctttgcctcagtttacctaagcgctcttctcttctaaatattacacttagcaaggctccatatatccattcagaatgtctcaacacaagaagttgcttgtagtaaaatgt

SEQ ID NO: 519 - DNA, 599 bp, Homo sapiens
ctaccgagagagacaaaagtatttataaatacttacaaaataggacttttgaaggaagagttttttttcacattttcacacttttccttcaaaagtcatatttttaaaaatagtcagattgatgacttataaagcagagcttggattatgggaacggaatggtgtttgagttacttttaacttttttttttctttgcttacttcatggtgcttctctagaattttgtcttgcttttgaacagcacattaatgatttggcttactcagagctgaaagcaatcttttagtgtatttgaagtrataatcagctccttggtcatacctggctctttccacaaaatggtgattattgattactggtcccattgcttcactgagatgaatcatctttcgtgaaacaaatttgtattcagcacctcctcagcgaacacttggttcctttcccagttgattaaaaatcatttattgcacactcattggttaggagatgaccattgccgtaatatgccatctagaaaaggtcttcattttgctttccattgcatgcagatgtagagtgtcgggaggtccctgcagcacatcagagggccagccttgag

SEQ ID NO: 520 - DNA, 599 bp, Homo sapiens
atcatctttcgtgaaacaaatttgtattcagcacctcctcagcgaacacttggttcctttcccagttgattaaaaatcatttattgcacactcattggttaggagatgaccattgccgtaatatgccatctagaaaaggtcttcattttgctttccattgcatgcagatgtagagtgtcgggaggtccctgcagcacatcagagggccagccttgaggcagcccactagaccctgctctactgcagtataatagagcaactgctcatcttgaagctgttgctcaagaagccaaaccaacrggcctagtgtttgctttgcgttgagcatctctctctcagtgctgtttcaggtgatgatggcacacactatctcaaagttctgtgcctcccacattgtttcaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtctt

SEQ ID NO: 521 - DNA, 599 bp, Homo sapiens
gtatctgttgaatttgttttaagaacagatttaggtatgatataggtatatacatttgggaaacactgaatcaaacaaagttacaagtaggtttcttagctgggcatagtggcatgggcctgtagtcctagctactggggaagctaaggcaagaggattgcttaagcacaggagttcaagttcagcctggtgaacatagcgagatcccatttctttaaaaactttcttttttttaactgcaggccttctcagagttattaatatgccgttgtgccttgtgaatttccaggaggagattaygatatgttgtgtttcccaaatttattttaccttggaattgtttaaggaacacctagttttttcccagaactttagtgttctgagagacacagtttattattcaagaattttccatataatgtaaaccttctgtaatactaattttggttcatagattattaaagagaaaaaacaaagtatgaaaggaaactattaattattaactattattttccccaaaatcactaaagccttttaaatgttaataaagaacacatctcattctctttaatgacaagtgtcatttattgagagtattt

SEQ ID NO: 522 - DNA, 599 bp, Homo sapiens
aaaataaaatccttgacggatacaacactactaggtgtatcattaaaatatattcttaatagaataaacacctagaatcagaacattggttgaaaacgtaggagctttacaggggcagtaaatttggagctagtcacatttcaaatttgccatcagtgtttctttgttgaatccagaagatagagcaaattgagctgatagtgtaagttagcaacatagttttataaaagtatttgagggactggccagaaatatactcctgactgtacatgtttcataggaagttctagaaacaacaargcactttctatatgcttttaggtggaatctccaactgataaatcaggaaacttcttctgctcacaccactgggaaggggacagtctgaatacccaactgttcacgcagacctcgcctgtggcagatgcaccggtaagtacgtgtgcaccagcccccaagttgttatgtgacactggtgcctcatgaaatcctgtgtgtggcatagggctgctgcggtttcagcactccctctttaacacatcttatttctaaatgttctcctgcacatgatttttaaaaaatgattattaatgtagagt

SEQ ID NO: 523 - DNA, 599 bp, Homo sapiens
agtccttggctccatgtgcatctaatccttgccataagccctgcatcgtacttcatattcaccatattgaactattcaccctcaagtagtcactattaaatgtcacactgttgtagcgactacaaatgcaagctcagtaactgaaaagataacattaaattttgttttttaattggtttcctgtgtcaatttcatgtttcgggaatttgtatggacagatagacaccagagagatatgcgtatttcacctgcatgcttgaggctagagaaacatgatttattcagaactatttcaaataytgtaactaacctggtaattttgtttaggaaaacattaaattcggaatagaaggcaattcagaatacctgtctgttatctttgtcttgtcatttttgagatactcagttcctggaaaatattatgataatccatcttgctatgtagtatttcaagttatatgttgagcctctgagcttgcagagtgaacatttctattcatagacagtgctgttgacatcagtggggagatggcacaagctttgtgccctaggaaagtttaaaagctagaacattacactgcaaaccctatgtcaggaaa

SEQ ID NO: 524 - DNA, 599 bp, Homo sapiens
tctctcccctaatcttagctgttttcaccctttccccacagcattgccttgacagttcctcagtgtcccatcccctcttcccatggacaacaccacaaacctgcgcacacggcctgttattattcctcctgtttcacctgtgtccattctgtctcataaaggacactgtaggctctgaacagctaaggcctttcttattcttttgtcccatggaaaataatccctccagatagcaataccaggaatagtgccttttctaacccactggtttccttttgagcttacagccaccaaatcttrtatctgtttgtttctgttcccctctctgcattgactgctagagagatcagagtcaagcaggaggttacatctagctggggcactgtgctttatgctggtgtttcgtgtgcaaatctcataccatcttcatgttacagttgttccttagtgtccatgggggatttgtttcagaacccgcaaggacaccaaagtccagggatgctcaagtccctgatataaaatagcattgtgtttgcatataatctacacacatcttaccatataattttttttattatttgtatacattcgtggggtac

SEQ ID NO: 525 - DNA, 599 bp, Homo sapiens
ctgggcttttgctgccaatagagatcaaaatctatgaccacttggtgccagctccttggcatgctcagaatacaaaagaactgggccacagggaagcagagaaatgacaggtcctggctggcactgagggtaatggaggcatcaaaggagctgtcactcagagaccccatctcagtggctgtgatggcagcaagggcctaggatatgccatcatgggaaggggctgcaggcactcagtggagccagtggtaacagtagagatgtcaggtacagagcctgaattctcagggactctatggraaaaaaaggagttggtgcaggcttctgggaatggggcccctggaatgaagtgaggtgggcactgaggtgtaagtgaggctcctctcctgggaaccagacttggtgggctgcagaggagcccccagcaaccaagcaacccccacaaccaggccaccagcctatgggtataaaggaagtcacatttcccagcaactctagaagaagcacctggggagccacctgacctcccatcagggaaaggggctgcctcttgacagcctcgcagaagtgcttgacactcttgtcctctccagaaaacc

SEQ ID NO: 526 - DNA, 599 bp, Homo sapiens
gaattgctccctcctctctctccaccacctcatccctccacccagaggtaagagacatcttcatagctctgtaattgtgactgtggctaagcagccgtgtgatcgcagggaaaggggagccaggcacgcgggaggggctcggacaggctctgacccatgctgccaacacacctccatctgtcagcgacagccctccctgcgtggggagttgatggagcggtgactgccagtttgctaacgtccttgtctgcggatgctgcaaagacatggttttccatggaggaattctgaggcttacaygcaagtcttctctgaattacagtaattaaagttgagaagagcaacacgccagaactcctcctttacctgtcatttctgggctgatgacggggctccaacttcaaggtcactctgtcctcctccctctttccttcctgcccctggctcctctccacaccaggcctgaaacagccaaggacccaaccttcccccatcacaaaaggcagccaaccagatccgggggaaaagcaggcaccttcgaactccagtgcttgggatttcaagttgagtcttactggcttggttcccagcaggaaaac

SEQ ID NO: 527 - DNA, 599 bp, Homo sapiens
ctgacaccgggtttattccactaccccagggccatttgttgaagccagccgttgtgttaagcgctttacataaattatttctaatttttacagcaacttttcagggtatcattatccccatttcaggattgaggtaatggagtgatttgcccaaggtcgcatagatagaaagtggcaggcgaggaattcaagtctgttatcccattctttctcataaatatccatcaggggcagagagaggcgagtctgagtgggtttggggatgtgtgagggtgtcccaaaggaagaagtcctgaaagstacctgctggaacatcccagctacaggcttccacggattacattcacctcaccaacggtaaggcccacatatggccagttgttaacaaacatcgtaccaagaaggaaaaaagccctgagtacaagtgcctggaggttgatcttcaacagggaagatgtagaaaggcagatgaaagctaaggaccctgaaactgacagaaggtcagggagaacctactaaaacccacaggtctcccttgggtttttgtggctaagctggtgggagtgagaagaaacccaaactcccaatttagtttccag

SEQ ID NO: 528 - DNA, 599 bp, Homo sapiens
acctcacagaaaatgatgggattcttgtgctcccagagcccaaattctatactcctcactcctacccaaggcctggaaaggtaagaggctttagcagagacaaatcagagaaggagtggggtcgggggggcaaggagtaagaaagtggctttgtggggaagacccagtcctacacagctcaggaatgcgctagagggctgaccagtcctataatgccttgcctttgtggacacaggactcaaacatttgcaagaagatgttagacaccataacgttagctctcgccacaacacgaaatarctagtatgtcattgtcagttgagttataccaactttctcatcatttttctttgcaaaatgaggacaataatagtatgcaccgcacaggatgtttgtgagaattaaatgagatgcaaagtacctagtatagttcctggcatataatcagcacacaataaatgttagatttttattgttgtttttacttctatcttgatgaaaaatgtattatttttacactgttataaacctaagagaaccatgagttaggttccacaaatttcattgctgaaatcatgtaccttggacagttctattat

SEQ ID NO: 529 - DNA, 599 bp, Homo sapiens
tcctgcgtctctgccaggcttcagcccgacaggaccctcacccaagcatgagaggttcacaaccttgaggagtttggaagggcacgcaaaggggatcgactgctcttttttaaaaagcatactgcagagctgtttggccattttacaagacttctgatacccagccctcctccactgctgttcaggttctaacccctctccttgcctagcccctttccagcatgagggtcagccttacactagcaccattgcccgagtggggcggggtggagggagttcaccacgggtgcatgttctgaytgatcagagcccacgctgttcaaggtgctacctacttcgaacatcatctctgcctgcatccctgtttcccattactccccagatatctattcccctacagagagtttgaccaccattcctcctagaatcttctgtcccagaatgacttacttttaccgatccagcccctacccatcctccacaaggctggtcaagcgtcttttcctcctggaagccctcctagatcagccccaggccagcgtttacctccattttctagctcccagaggctttttcgaactgcaggtggtgtatcatta

SEQ ID NO: 530 - DNA, 599 bp, Homo sapiens
agatcagccccaggccagcgtttacctccattttctagctcccagaggctttttcgaactgcaggtggtgtatcattagcaggtcatggacatcaattcagggcattgcaatgagcattctttaaccaaatagaatacaaaatatcagaagataccgtctgtgataaagatcacagcatgtatatgaacatacgtatgtgtcgcatactgatgtgatataaaaaacgttccttactgcttcttgcagtcaaaacctttgaaaaacattggatattaatgccttccatcctaaatagtacyaagcatctaaaatctgcctaacttctccaaagacaccaggagtgaagtcagggagaagagaggagagtgagggggtcagccaggctggagccactctgacatgggagaggaaagtatatgaggacagggactaggtttctctacttacctctcccctggcacctggcataagtgtcaatgaatgggtagcacaccagttaggctagattactctgtgataacaaaagaaatcaaggccaggcgcggtggctcacacctgtaatcccagcactttgggaggccaaggtgggcggatcacg

SEQ ID NO: 531 - DNA, 599 bp, Homo sapiens
aagtgcagagaacaccagcagggcaaagggaagtgatccaggagatgcattttattaagcctgttacctcagtggatgtctgaagcccaatcccatggagaaggtctggaaaatagtgtaaagcgcacctcaaaattatccccactttagggttgaggaagctgaagtctccctcaacccgctccccatcagcgctgattcaagctgctcctgagggatgttagtgccccagcccttccagcctgctccactcactcaggggagtggagtaaccttccagaaaaatccctcgttcaaagscaggtgaagttcccagagcaaacttctcagtaagggtaaggtctgagggaaatgagcaggaaactgacagccccagcttccacacaggtgaacttaccaggcaggagaagaaagaggcagatatgcaaataaacattagcaaaggagaaaatgctacaattgaggaagcaacaaagcgtccaggcacagaggaggtagcagctgatcctcccaaggatggaaaaagacttcctagaagtgatcaaatctgggctgaatcctgaaggccaagtaggagttacctctgagaagaggaagaa

SEQ ID NO: 532 - DNA, 599 bp, Homo sapiens
agaaaatgctacaattgaggaagcaacaaagcgtccaggcacagaggaggtagcagctgatcctcccaaggatggaaaaagacttcctagaagtgatcaaatctgggctgaatcctgaaggccaagtaggagttacctctgagaagaggaagaagagatgcaatggggactgcttgcctgcccatcacctccattgtccctttcttcccagctgacccagttctgcttagggtgcactgtgctcagccccaggtacctctctaggactggtctgcacctgttgcaaaatccttatgcccrtttgccagagtcttggttttccagcctctcttgcacctggcagtgggcgtgtcaactggccctggccaataaaggtagtaagagggggttgggtgcaatggctcacacctgtgatctcatctcagcacttggggaggccaaggcaggaagattacgtgaggccaggaatttgagaccatcctagccaacacagcaagaccccagatttcttttttttaaggtaataagagggggtctgccagggaggattctgtggcagcatttgctttcctgagctaaagagcagatggatttgctgc

SEQ ID NO: 533 - DNA, 599 bp, Homo sapiens
agccctgacctcaggtgatccacccgcctcagcctcccaaagtgctgggattacaggcgtgagccacctttttttcatttttttctctcacccaactattatttcaaaaccaaagatgacgggagaggggaaatcaagtgttttctcattgggcattcaaagagtgaccaattaaccccccaaattaggcaagtaccagggagacccataaagatgagacattggacttcatgttcacacacccatcaacactccagccctaaattatatttgacatttaattaaaaccccaaggcagcraagtcaagagttgaactgctacagtactggaaaaggagccgctctttaggatggattcatttacctcctgttaccaaagccatcaacactgacctcccccagcccagctttactcactggtagaaatacaacagaggcatgactggggaagtgtgttccccgtctcctgcactcccctcatcgcctccacagacatactcagacgccatcactgccagagtggaactggtccttctcaggttccatgccacccagcactaacttccctcctggccacccatacaggaagtcacccaacc

SEQ ID NO: 534 - DNA, 599 bp, Homo sapiens
ttccttctctcttctttcttccttccctccttccctccttcccttctctccttccctcctcctctccttccctccttcccttctcctctccttcacttcctttcttctctccttcctttccctccttccctccttccctccttctctccttctgtccttccctccttctttcttctctcctttcctccttcccactttctttcccttctctccttccctccttctctccttcccttcttccttcctgactgcccacatgatgcactgagcagcctccacattctagtgccatgctaaatrttacaggcacacaaagatccataaaacaactcttgcccttgtgatcttctggtggagacaaagcaatttatgaaatgcctaatatctatattagatataataagacaatgtgtgccaacgaagagtccaggcaacaggagcttccaggtcagaggaaggagagacctgagtagttagaaaggaccttgctgaggatcaggactcctgctggacctccaagaccgccatgacttagaaagatgagaggaagaggaaaggtgcagggacagagaacagtacatgtgaaggtctagaaacag

SEQ ID NO: 535 - DNA, 599 bp, Homo sapiens
agaaagtgtccttggaccccagacgccactctcttcctccgattttgaggcatcaaaacaaaatgatgctttcctgatacagatcacaaacccagcagagaatcaagacacattagcactgattcaaacacacatgaacctcactgtcttagaaacagagcatttcaaagcctctcaactcaccttgatcacaatttcatccccagaagatttaggaagtaacaaaggcaacagccttttcaggattaattctgatccaccaggaagaaattactgggaatctgaaatgacagaaaccayagacagaagagacaggatattagaagaaagtgaacatgtcatcttagacttcagagcagcccagaaagagaatagtagagagacatgtgtcaaagactttagaaagtctaatttccagacatttggagaaaaggtagctacaatccagtaaccagagtctctacaggggaagatatttcaagaacgaagcgtagcagtttctggagacaaggttctgtctacacaattgcaaaatatttcactgggggagaaaggagaaagaaatcttaaaaagataataacaatttcagctgcactag

SEQ ID NO: 536 - DNA, 599 bp, Homo sapiens
catctacatgactggtccaggccctggccccagctctgcccagcactagctatgtgaccttggacagccatgtcctctctcaacctcagcatccttatctgaaactcaagggactgggctaggttcttccagacccttgcagcagtaatgttctgggagggatggctttaagacattaagcataatataggccttggggaagcctgagcaaatgtgggtggaggctgggggagcaagagtgttggttggacacagcccagaacccctcactgtggtttgtttgaaagcttggtaagggcrtgttgcaaggagaaaggacattgacctagcaaatggggcctgctggcagacctgtgctcagcacacagagctcagctgtgtgagagtacacaggagagcacacacacacacacacacactacacacatcacatacacacagagagtcagcttttggcatgctcctagctgaggaggaagaaactagagccacagagagggacagagggacagatagggataccgttttttttttgtttgttttttttttgagacagagtctcgctctgccacccaggctggagcacagtggcacaatca

SEQ ID NO: 537 - DNA, 599 bp, Homo sapiens
ctgttctgcttcagttctgcacacagcgaatcccagaataactgcccccattttaaaaagagaaactgaggcagtctcactaagagcattccagcagactggaagcaagtcggaggcttcggctgctgacaactatctgggtttcccttttagtgctggccaggagggagggagggaggcaggcagggaggggagtgtggtacgggacggctcaggtagagggtggtgctggaaaatacctcaccctcgatggaggaaaaaaccacagccaaacagctacgatcagcagggaggaaagaraggaacattctgggctctgaggcctgtggtcagataagtggccccaacctgacttcctctccatcctcgatgtgcttttccatttatccttccccttgcccataagccagcctccaaacagaggagcatttgataacattcaagccccacagctctctattccgagcccctgttttttttttttttttaggctggagtgaagtggtgtgatctcggctcactgcaacctccgcctcctggattcaagtgattctggtgcctcagccccctgagtagctgggaccacagacacgtgccac

SEQ ID NO: 538 - DNA, 599 bp, Homo sapiens
aagatgcttttcacttaacttccagccctgctgttgacctcactctctgttttcaatctccacggatatttctcaatgcgttgtaaatgtctctcaaaacgaaactcacacttgaccaaactcaggttatctccctgaattctgctctctttaagttcacgctgggaatggagtccaggagccactgaaggagaccaggcttcctcttcgtagacatgtaccccatgtgtcaccgagggccggtggggagagagggagttggtgcagttgtctttccgtatgcttatcctgaagcatccstcattccccttaataccctgtcacagagccatcgtctgccaagtcaacgaagcccctagggaacctgtttctatttctagcagatctctcaagggctggtgcgatcctatgtttactacccacagtgtgaggagggcctttctgtgtggcctaaaactgcttcccccggcctctctgagggcccccgttctgggattcagcatgtcctccccggccaatggcaaggggcagggggctgaatcccctgtccagtcctgttgccgtgagccatgtcggggggactccacaaggcctcaggg

SEQ ID NO: 539 - DNA, 599 bp, Homo sapiens
acaaagatttattctctcacagtcctggaggccagatgtctgaagtcacagtgttagcaggaccagaggctctaggggaggatccctccttgcctctcccagctcctggcagctgccagcattggctagcttgtggctgcttcactccagtctctgcctctgtcttctcatggccttctcctctgtgtctcaaatctccctgtccttaattttagaaggacagcagtcattgaatgtagggcccaccctaaatccaggatgatcttacctagagatccttaatcacatcggcaaagacamcattttcaaataacttcacaatccctggtaccagaatgtgcacatgtctttttgggggacaaaccatcccactgcactggtctgctactcattcccttgcaagtgatcctctctgccgaatttcgagacccagactcttctgtgagccatgcaaggcccccactttccttagccagccgcatttctcatattccccacagcatatcccccaccctgccggcagccctctcactttacccccatcaatgtccttctttcttttgtaacttttttttattttactttaagttccgggatac

SEQ ID NO: 540 - DNA, 599 bp, Homo sapiens
aagatctctctgtcttctgcacaggccaaataggagaggtgaatggggatgtggttggaattactatctgtccatgcttcaaggcttcacactaatctctgcaatttatccaggatgaaatattgcttttggtttactattttcctaagtagagctctcatggcctccaattggcctttccaccaaaatagctctcactctgtaggtcatggaaccaatatgaggattcttccagctgctaaatatgtctattccaattatgcatctagaactggggaaataacctggatggtctcaggkacccactgaacccactgtgaaatgaacctgagctaaaattccattaatcaccttacctccaaagacctctgttaggaaataaaaaataaaaaacccacaaactgttttttcctctgctctcacatcgcagcaacaatcaccacagaagatccgtgactaaatgtgtggggatttctccccaccaaaaagcaagcaagcaattctgtaccaactaggtgtcctccaattcaattaattttgatgctttctacctagagataacctcagaaaccacaagttgagggctcagtctctaagac

SEQ ID NO: 541 - DNA, 599 bp, Homo sapiens
ttgagattcatacgttaaaaactattagtctaaaagctagtattattgttaactttggcttgtaactcctattgacagaaattaaggctgttgaggcagaaataatttgataaaggtttattggaagccaaatgtgaggatcaacctgggaagacacatcagaaagttgggagtgttccagaatctgttacaagttggaaggcttttataagtaagtttaggagaagggagaggggctcctcatagtgaagttgtcctttttcattggagggtacaacacaaagattggctgcaaagtaygacatacagggcaacatacaggttaaaattctatgcacaagacaatcagtgaaacttcatgattcagaaacaaatcaccaaaacattatgattcagaaacaaatcagcagcctttttgatgtcagtaggttataaattaatcattatacgtcaataatttgagaaactcagataagattctttactcatgaacaggatgttgccatgaatcacaagactgccccaagataggttaatttaagaagccctgtttacttttaaagtaaactgccaaatatgaactgtaggttatcacccca

SEQ ID NO: 542 - DNA, 599 bp, Homo sapiens
tgttgtttaatttccacaaatttatacattctccatttcacttcggttattgatttctaactttatgtcatttggtcagagaagatactttgtatgatatccatcttttaaaaatctattgagacttaatttgtggcctaacatatgatgtatcctgcaaaatgtcccatgtgcacttgagaaaagtttgtatactgtagttgttggagagaggattgtgtatatacctgttagtctggttggtttattgcattgtttaagtcttctgtttccttgcttattttctgtctggttgttctmaccattattgcgagttgggtattgaagtctccaactattgttatagaactatctctttttccctttcattctgtaagcttttgctttatgtgttttgatggtctgtccttagatgggtaaatgtttataattgaatatcttcttgctgtgttgggtcttttattaatatataatgtccttctttgtccactatagccctgtaagtttatttcgcctgggagcagtggctcatgcctgtgctcctagcattttgggaggccgaagcaggtggaacacttgagcccaggagttctagacta

SEQ ID NO: 543 - DNA, 599 bp, Homo sapiens
agaattcaggaaagggcaagtggaggaaaagagaggagaggagaagagaagagataaaaatatgaaaaagaagtttataatttagaagatagtatgagaagagctaatatatgtataattggagccctagaagaaaggactaaagaaaatgaaggagggacaaatttaatgagataatggctgagaacttttagaattgatgaaatacatgagtccacatgctgaggaagcatattgtataccatttagggtttttttttttaaaaagcaactcatgattagatacatcagaataaagcrattcatgactagacactgcataataccaaagataaagatatatttaaagcattgataatgaaaagagagattacatagaaataaatgaaataaggcagattatgtattttttccagttttttatgatgataaaatatacataacatttatcaccttaccctttgttttttttttttttttgagacagagtctcactctgttgcccaggctgggagtgcagtggcatgatctcggctcactgcaacctccacctcccaggttcaagtaattctcctgcctcagcctcccaagtagctggg

SEQ ID NO: 544 - DNA, 599 bp, Homo sapiens
ttcatctctgtttctctctctatgtcatttacattctctttcctttttctgaggccatgcagttctctacttctttttacgttttatagaagatggctgtcccacagtttatataatcctcagtttcagtcacacacggggactaactgactgagaaatagaacctgactgatccatctcaggcaaatgtaccccctgatccaatcagctgtaactacaggtcaggaacacatagcacaaagatggctgtggacttcccagccctgaggaagagaggaccaattctcagacaggaataaytgagcaaaaatatgtcttccaaacaccctgtcctctcaatccctgttgttgtttctgccttcattcatcatttcactatgaatggctgcaaacatttcctgacaacttgcctttcttccagccttttcttctcaatccactctctaccagagtgatctttgtacaatgaaaatcgcatcatgttactttcctaatgaaaacccttcaagaattctctataacctctatgacaaattccagacttcttaggttggctggaagaagtaatttactaatttgagtcctaacgcctaatcttt

SEQ ID NO: 545 - DNA, 599 bp, Homo sapiens
tgcttattattcacaacaatcctatgaagtaggtactattattatccacattttgtatataggaaaattaaggcacagagaacttaagtaacttgcccaaggtcagatactttatacatggtagaggtaggctccagagtctgcttttgatgattatgcaatattatttctctgaaactggggttaaattgattagtagctggttgtgagcaaggataagtaggaaggttacattttgctgagactttgtgttaaatatggctaagagcacatgttctaagtcaggctgtctggcttcaratcccacctttgctacttatcagccctgtagctttgggttatttgattcacttcctatatctcacttttctcatctgtgaaacagggttaataacagtgcctacttcagataatgctattagcgccaactattaaatacttaagccttcagatagatgataacttttattagaacaccttgattcaccatggggcaattttcctgaattgtagaatgactcccacaaaaaaaaaaaaaaaaaaaaaaaaaaaaaaacagaaaaaaactgcctttttaaaactcacttagccttccaagt

SEQ ID NO: 546 - DNA, 599 bp, Homo sapiens
tttggttaacccgtttgccaaggaaactaaaaaataaatttgaaaaggttctttttgtaatgccaaaatatttgttgaacagattgtgaggccacttgaatcactttagctcactcctgggctcaagtgatcctgaatgagagttattttaaagctggagttactttgacaaagagcatgcctctctgaccgctcagctgtgtctcgtcttgcctttgctgaatttcactcactgtagcatattacatttgtgaaagatggaaacgagttttcacatgtgaaaaatggctatcagaggaygggaaaactttagtagaagttgaaagggagttaacacctgtggcttgagaatatgcacagaaaacaggagactctcagtgggatctatgatttgagggaaggtcaggtacctgcctaaacatttctatgttcacaaatatggacattcatgaccatctttgaacatgttcatgttgtgtgttaaagttttattgttttgaaccatgatttcttattagttaattaccctcaaactcagaacaaaactgattaagttgctcactaacagcatgtgatcactttccaaatgtgtctttttc

SEQ ID NO: 547 - DNA, 599 bp, Homo sapiens
cagtgagtgaaattcagcaaaggcaagacgagacacagctgagcggtcagagaggcatgctctttgtcaaagtaactccagctttaaaataactctcattcaggatcacttgagcccaggagtgagctaaagtgattcaagtggcctcacaatctgttcaacaaatattttggcattacaaaaagaaccttttcaaatttattttttagtttccttggcaaacgggttaaccaaaaggatcttctgtaagtggacaaggattgagaaaactaaggaatttgatccattgaacctattgtsacggaaatgcagtggttttgtatggacctaaataatttgggcaacatagcgagaccttgtctccacaaaagaaaaattgaggccaggcgcggtggctcacgcctgtaatcccagcactttgggaggccgaggcaagcagatcacaaggtcaggagatcaagaccatcctggctaacacggtgaaaccccgtctctactaaaaaatacaaaaaattagccgggcttggtggcgggcgcctgtagtcccagctacttgggaggctgaggcaggagaatggcgtgaacccgggaggcggagc

SEQ ID NO: 548 - DNA, 599 bp, Homo sapiens
gagttccaacagctttgactttgaattacttattttcacaataacacaaacaaaacttgatataataaatgcatatatccttagaattgacaatatatattttatatgaccatgatttgtacaaaaattgtatttgctgcaaaaaacattaaaatataaaacagtaaagatttttaaaaccacaaactctgatcctcatccaataaaatcagaaatatatcatataaaaatgaagtgacaagagggcagaatagaaggtaacccgctcatatctccctataagaattctgcatccatccrtggtaaaaagtcactctgcaggagcctcaggattgaggtaggagtttgtgaaaccctagtgaagtccaagacatcagaggatcatttgcagagggaagacctacacataggtggctgatccaccaagcttgttcctgggttcaagccagaaaatgacccagtctcccaaggggtttggatacaaccccacttggccttgatcctgcaaccaaagccatctgccgaggagtcaagaaggaattgtgcacactaatagaaaggctcatctacccactgacagtcgtgttggcagtcaatct

SEQ ID NO: 549 - DNA, 599 bp, Homo sapiens
gatagccatccatcttggccaccaggacagtcttctggattcaggtccctgtccagcattcccacacagcccaagtaccctccttgagtcttcccctgatccttctgggctggaaagctgtgccaatctcatagtcctcatgagacttgcagcaagcctgtacttagagcatcttctactgctgagatggctgcagaggtcagaggctcagagaaaacaatagtcagactgtatagaatccctacaaggataagcacaaagaaagctagactacaaagactaaaatattaaataaatacytaacctatcaatacgcagacatcatttcatgttcacagcattaaaaacacacacggaaatatgactcttcatatggaaaaactaaggtgccagaggctgaccctaaagggatagagatatgcactttcttagacaaataatacaaaatagctgttttaagaagcttgattgacttctacaaaatacacataatcaattcagaaatgtatcagagaaatttaacagagattaaaataattaaaaaaaaaaaaacccagaaatcctggagctgaaaaatacaatgaatgaaaggaaaaatg

SEQ ID NO: 550 - DNA, 599 bp, Homo sapiens
atatggaaatccatgagaaaacactatgcttagtcagggccatgtgacaatagaatttctgcagacagtgacaattaaattgagatctgaaaagtgagaaagatgtatacagattaaagagaggttggttggagaaaatatttctgggatagagaataacccttacaaaggcctggataggagagaacgaaagtaagttgagtatggcgaaagtacagagcaagagctcaggatgaagtgtgtaatacaaactgcgaagaaaggctcagcccagatcaggaaggctttggaagccaaatytaggagcttggactttaccctacatgcaatgtgaagacatggctgggtgttaagtagaagagttgcactggttcttttgtttcccatacctccagatccattctctgccctggaaatcagatccccatagggtctgtcacccactctcccttgcctactggcttccagatgggttcagccaatgcggtgccttttccctgggtccccttgcttcagtgctacacccgatagtaaatgtatccctccttgaacacaggtcctgccaggcagcccttttgtggctccagctttcactgagt

SEQ ID NO: 551 - DNA, 599 bp, Homo sapiens
ccttcactaggagaggtaattttggcaaagtaaaatagggatctgtcacccaaagatatggaaattgttcctgagcagaaaacacacaaacaaaaccagctacccctgcagtccctgttaccaggtactgttctctactttcctccctccaccctatagaatatagcctattctatattcctctgggataatggcttccattcttccttcctgggaattgcagcctaactcttgtcgctagtctggtggcctggagcttggtgacccaccctggacagtccttctgagcctcagacctgstatctatatatttattgaattatctagttactttagcttgcaacttttgagagtaattattaagagcaggttttgctcaaatgtaaacagaagttttaatgaactttcaactctcttcttcaatcagataaatatttcttggcatcctctgcaccctggacagctccccaagtgaccttctgttactcacaatctcttctaatttccatgaaaagtgaattaaagccatgacattatcttcccatttggtctatatctttctttaccttctttcttcctcccaaagtctggcccacttc

SEQ ID NO: 552 - DNA, 599 bp, Homo sapiens
aaacctgctcttaataattactctcaaaagttgcaagctaaagtaactagataattcaataaatatatagataccaggtctgaggctcagaaggactgtccagggtgggtcaccaagctccaggccaccagactagcgacaagagttaggctgcaattcccaggaaggaagaatggaagccattatcccagaggaatatagaataggctatattctatagggtggagggaggaaagtagagaacagtacctggtaacagggactgcaggggtagctggttttgtttgtgtgttttctgcycaggaacaatttccatatctttgggtgacagatccctattttactttgccaaaattacctctcctagtgaaggtgcaggccttcccaaggttaccaattcattttcttcctttgaatgttgaatcttcagtagatatttaaaaatgaaaaatggttagtatgaattcctctgagctttgcagcactcatcccggggacactgactcacaacacagtttatatgaaaagaggggatgctcatcatcccctgaagttcaagacgaggctgagaaacatagtgggactctgtctctacaaaa

SEQ ID NO: 553 - DNA, 599 bp, Homo sapiens
ctgcaggggtagctggttttgtttgtgtgttttctgctcaggaacaatttccatatctttgggtgacagatccctattttactttgccaaaattacctctcctagtgaaggtgcaggccttcccaaggttaccaattcattttcttcctttgaatgttgaatcttcagtagatatttaaaaatgaaaaatggttagtatgaattcctctgagctttgcagcactcatcccggggacactgactcacaacacagtttatatgaaaagaggggatgctcatcatcccctgaagttcaagacsaggctgagaaacatagtgggactctgtctctacaaaaaaaaaattctaaaaattagtcatgcttggtggcacacacctgtagtgccagctactcgggaggctgaagccagaggataacttgaggccaggaggtcggggctgcagtgagccatgattgcaccactgcactccagcctgggtgacagagtgagactttgtcacaaaacataacaaaacaaataactaaataacaaaacaaataacaactccctgggaaagctgacttttagcttaattcctgcccttcaatattctctata

SEQ ID NO: 554 - DNA, 599 bp, Homo sapiens
catcttactgattgtactcatgtgttaacattcccaccaaaagtgtaatagtaaatcactctcagttattaattggtgttcaattagaaaggcagaatttctctaggcattcaaacagagagaataaaatccaaggaggggcaaaaagggccagtgatggtacccagaattcaaaagagctatgttgctgaggttgccagcatccttttgttaatgctgctgctgctgctattgaaaccactgctgctgttacctttcaagaggctgagaatttgcacatttacagaagctgcaagaacktgggagcccatagtccccttgatgttactggactcactgccaagacgtctggatcctgtggctgcctgtggctactgccagatccagaaacagaaaatggaggataaaatagcttctcccttttgccttctggtctttctctgagacctgcctttgggaaaatctaactggaaactacctagttaggaaacttgggaatctagtttgtaaatttttagcaccttacaatatagagaatattgaagggcaggaattaagctaaaagtcagctttcccagggagttgttatttgttttgtt

SEQ ID NO: 555 - DNA, 599 bp, Homo sapiens
ctgaggtttggttaagttatttgcctaagataacactgctaataggtgggggagcctggtttaaacacaagtctgttcaattgtactgcatcttactgattgtactcatgtgttaacattcccaccaaaagtgtaatagtaaatcactctcagttattaattggtgttcaattagaaaggcagaatttctctaggcattcaaacagagagaataaaatccaaggaggggcaaaaagggccagtgatggtacccagaattcaaaagagctatgttgctgaggttgccagcatccttttgtkaatgctgctgctgctgctattgaaaccactgctgctgttacctttcaagaggctgagaatttgcacatttacagaagctgcaagaacttgggagcccatagtccccttgatgttactggactcactgccaagacgtctggatcctgtggctgcctgtggctactgccagatccagaaacagaaaatggaggataaaatagcttctcccttttgccttctggtctttctctgagacctgcctttgggaaaatctaactggaaactacctagttaggaaacttgggaatctagtttgtaaa

SEQ ID NO: 556 - DNA, 599 bp, Homo sapiens
caccactgacctggctccattgtccagtcccactcttagaggagaaaggctctggccaagactgttccagaaggataataccttttttttggtctctttcccagatataagaaacctggtgacatttctgcctccaaatttttgtgtaatttaagaacagtttcctcctctgagcttaggttctctgatctaaaatatgagaggtgagagtctttaaagcatcatccactactagtatcttataattctatttcagcataaacatctttaattcccaatcttttctcatgaagacaccakcatgacctcttattcttatttatatcttttggactccaaatacttcattttagagatctagtgctctgaagggtcaaaggggcaccttgtgaaaagccatatttgtctctttacattcaccatgacttatactaaattataataagtgtgaaatgtctccacggacagatacaaaataattttgtatcttctggccagggtccggtggctcaatgcctgtaatcccagcactatgagagggcaaggcaggcagactgcttgagctcaggagttttaagacaagcctgggcaacatggtg

SEQ ID NO: 557 - DNA, 599 bp, Homo sapiens
caataatgcaatctcagctcactgcaacctccgcctcccaggttcaaatgattctcccgcctcagcctcctgaatagctgggattacaggaacccaccatcatgcccagctaatttttgtatttttgtagagatgaggtttcactgtgttgggcaggttggtcttgaagtcctgacctcaggtgatctgcctgccttagccctctaaagtgctgggattacaggtgtgaggcactgcatccggcctgaatgttgcataattttggattgcatcctcaatattgtgaatgatgtgttgtaraaattccggaatctgaatgttcctctgaatagtactgattttaagcatatatttaacttttatagaatgaaactgtaacactgtatttccactgtgatgagtgtagctgaaattttacttcaattcctttaactttaactaatttgctttgagtctttccccaatagtcatgttcaaggatcactcagagatttgggaaaattttgtacctagaatatgagacccattgtttggctctctcctttctgggagtttcttcttcactttccagtggatctagttccccaaacacaagtcct

SEQ ID NO: 558 - DNA, 599 bp, Homo sapiens
aagaagcaggaaaacatgaccaattcataggagaaagattaatagaaaacaagctaggatgacccagatgttggccaacaattatttaaaactgtatattaaaatgatgctcagtagtaaaaaggaaaatatgctcacagctaataaaaagtgggaaatttcagcagaagaaaagagattatttttttaaagcccaaatagaaattctagaactgaaaaacaaaacagctgaaatataaaattaactgggtaagcttaagaaccaaatggaatgatggaggaaagaaacaatggacttamaagtcaatagaaattatctgatttgaagaaggcagagaaataaattttaattaacagagcctatggatctgtgagacaattcaaaactgaagacctgaaagaagacgagagagagaattgagaggaaaatcatggcccaaattccctaaacgtggcataaaacatatagttacaaatttatgaagcttagacagaattagtagaaaaaacactcctatttacatcataatcaaactatggaagaaaaatatttgaagacaaagaaaaatgacacattgaatacagggaaacaattaaaa

SEQ ID NO: 559 - DNA, 599 bp, Homo sapiens
catggcagtaccaatgggagcaggaatgcctggcctcaataacaataggagccagaaaccacacatgtatttactaaaatgtctttcaagagggcacacctgtaagtctctgcattttgccacttatacaacttcatctttgagcgcttacatagggtcagattacctaacaatagctgtaagccaagacaaaattggaggaggagagaattagtagatacctgatacaggatataagggctaagctttagatttttctatcctgactcgatccagggtatttggtttctattgtttttmactaaataaagataggtctttcaacaatcccagcttctgtggaattagctgaaaataaaccaagagctagagactcaaagtatttacagtagatacatttgagtaggtatattgctcaagtcacactgtaactgcccagtgggttcattttgcctgctgcccagataaactcaatttattaagacagaggaattgtaatagacaaagagtttaattcatgcacagccagctaaacagaagacagaaaattcagagattggagttttttaagggcaatttggccggtagggggccagaga

SEQ ID NO: 560 - DNA, 599 bp, Homo sapiens
tgggaggtggagagtgggcctggaggggtgcacagaggcatccagccaaaaggccaggggtttccttttttaggctactgccctcagcagtcatgtctctctgagggccaggaatctagactgaattgaagctggcgacataatccctgggtcactcatgtctttctagagtgacactgcctcctggaggaaatccctgatggtgcctcatttttatttcttttttttttttacatcctccgtgtccagtacctgctcataggagacacagtaaagatataggtgttgaccaagtgcacrtggaaaacacattgttgttctgcatcagtgattttaattaaaaaatacgcctctgaaagaaagaaagctcactggtttgtagtcctttaaacaaagtaatgtgatatttagttgaggtttaagttattgcaccacgtctctagtacagttcagtgtctttctatttttagacaaaggtaaaccttatttttgtttcctttcagaaggggtatatccactgagaccagaggccaaactccctttgtacttttctttttattttattttttttgagatggagtcttgcttcatcacccagg

SEQ ID NO: 561 - DNA, 599 bp, Homo sapiens
ttcagtgtcatcagtcattggggaaatgccaatcaaaaccacagtgaaatgctacttttcacccactaggatgcatgtaatttttttttaaaaaaaaaggaaaaataactattgttgagtatgtggagaatatgaaacagcttttacaaaaatgtccacttaaaagtaattttttaaaattgaggtaaaattcacatgatataaaattaaccaatttaaaatgtacaattcagtagcatttagtacattcacaatattgtgtaacattacctgtgtctagttccaaacagtttcatcacyccaaaaggaaatcttgtatgcataaagcatccattccccattttcccttacctctagcccctggcaaccatcaatttgctttttatttctgtggactgtcttttctggatatttcatataaatggaatcatacattatgtgatattttgtgtctggcttctttcacttagcataatgtttttattcatgttgtagcaagtatcagtaccttattcctttttatgtctcaacaatattctgttatgtcaatataccacattctatttatttattcataagttggtgaacattttaattga

SEQ ID NO: 562 - DNA, 599 bp, Homo sapiens
cattaaagggtgacagattttgtcaaaagctttttctgcatctattgagataattatatgggtggggttttttccttcattctatgggtgtgatttattacattgattggttgttatatgttgaaccactcttgcatttttggtataaacctcacttagttatgacatagaaccttcttagaatgttgctggatttatgcagcagttcttatagggcaggtctactagtgatgaactccctatgttgccctgtttttctttatctgataacatcttaatttcttaatgtcttacttactstctcatttttaaagaatagtttttccagatatagaatttttggttgacaatgtttttctctcagccttttaaatatgttgtcccactgtcttctggcctccatggcttctgaagagaaactagctggtaatcctacacatgagtatcccttatacatagtgagaaacatctcagttgctgctttccagatttgctttttgtctttggcttttaaccgtttggttatagtgtatctcagtgtgaatcttttgagttatcctgcttggagttcattgagtatttcgaatgtttaaaatctt

SEQ ID NO: 563 - DNA, 599 bp, Homo sapiens
tgtctttggcttttaaccgtttggttatagtgtatctcagtgtgaatcttttgagttatcctgcttggagttcattgagtatttcgaatgtttaaaatcttggttactaatcaaatttgggacatttttaccatcattttgccaaatattctctctgttccattctctctcctttccctataggactctcattgtccacctgttggcatgcttgatgatgtcctacaggccttttagactctgctcatttttttcccattctttttgctttcttttcctcggactggaccatttcaattracctatcactggttcttgcttctgactgctcaaatctgctactgaatccctctagtgaattttttatttcagttattctacttttcaacctcagaatttctatttggttcctttttataatttatatctattatttctattattgatattctctatttgcaaagacataattttcatggtttcctttagctctttaaatatatttaagacagctgatttaaaggctttgcctaataagtcatatatctggtctttctcaagaatgattactgtcactttttaaagtccatacttcattg

SEQ ID NO: 564 - DNA, 599 bp, Homo sapiens
ttccatgcaagcaggaagtgaagaccaaagcagagttgtaaatggctttgctatgcgttgaaggcatgtcccaacacagagccaatctgaaaacactaggggaataatttttctttttctttcttcagcttctatttttggctctagttgtttaaggaaatcattgtcataacactagctgaccactaagctaatggaacaccgacttcagtgaccacacataacaaagaatacagactgtagaaaaatgttttagaaaagtcactaaacagacagataacaacaacccactacaagcarcaacaacaaaccatggggatgtggagaactgaatttcctgagttactgtattataatgtgcaaaatgtccacctttcaacacaaaattatgagacactcaaacaatgaagtatggactttaaaaagtgacagtaatcattcttgagaaagaccagatatatgacttattaggcaaagcctttaaatcagctgtcttaaatatatttaaagagctaaaggaaaccatgaaaattatgtctttgcaaatagagaatatcaataatagaaataatagatataaattataaaaaggaaccaaa

SEQ ID NO: 565 - DNA, 599 bp, Homo sapiens
aatgattaataacattcttttcattctcaaaaatttatgattcagataacaaattatacgattactagaataaagtctgtatgacctaacccttagtcgtcctgccttctagagccatgctttcatcttcattcaactagctacttgaatagcatggagtaacttgtggcagtccaatattaccattgagtacaaccagaaaggcagatcaggagagagctgctgaagcacgaaggatgaggggctaagattccatggagagattagctaacagtagttagctactttttaatagttacragagcattggccaaggcagggaatctgtattttaccaaggtaggaggtcactgccaggagacagagaaatcactgttgatcggtgttgtgggaatgaagagacaaaattggaaattggaagggccaggcccccagcaagaagagagggctggagaactgaacctacatataatgagtttcctcttcaaaacacttgccgaattacgcagctgcatgggggcaaaggcaaaaaaaaaaaaaaaaaaaaaaaaaatcagcctcttaaaagcagagctgtggttttagcagcctttttggtt

SEQ ID NO: 566 - DNA, 599 bp, Homo sapiens
tgacctaacccttagtcgtcctgccttctagagccatgctttcatcttcattcaactagctacttgaatagcatggagtaacttgtggcagtccaatattaccattgagtacaaccagaaaggcagatcaggagagagctgctgaagcacgaaggatgaggggctaagattccatggagagattagctaacagtagttagctactttttaatagttacgagagcattggccaaggcagggaatctgtattttaccaaggtaggaggtcactgccaggagacagagaaatcactgttgatyggtgttgtgggaatgaagagacaaaattggaaattggaagggccaggcccccagcaagaagagagggctggagaactgaacctacatataatgagtttcctcttcaaaacacttgccgaattacgcagctgcatgggggcaaaggcaaaaaaaaaaaaaaaaaaaaaaaaaatcagcctcttaaaagcagagctgtggttttagcagcctttttggttttgttcttgtttcataaaaagtcaagagttatagttcatgactgctgggagaaaattgaataatttttagaaattgtttca

SEQ ID NO: 567 - DNA, 599 bp, Homo sapiens
ctccatatatatatatgttctccatatatatatatatatatatatatatatatatatatatatatatgtctacatcagaaaatttatatgtcagtaaatctgataccataagggtttttctggagatgtcagtcagactgtgccaaaatcaatgtatctttcattcaagttgaaattttggcaaacatggtggaaatcaagaggttcattggaattcaccttctttgtatctcagtttgtagcaggaacatttagaaacattaagaccaaatataaactcctgaaacagcagaaagaaakggaccttaattctatcaacaacaaaatgattgggttgggttcaagaacttcaggaaatcatggtagaacgtctaatctcttcggtttcctgtagattctctggtgctgatgtctgcaagcaaaagtaacttttaaggggacacaaccttagtgggcctcaaaaagttcaggcaaagttcagtatgcagggagtggtaagggggagtgaggaattgggggcgcttcctccctatagcggactcctggcacatgctgctcatgttattatcggtagattacagtatacctacgaaggtatt

SEQ ID NO: 568 - DNA, 599 bp, Homo sapiens
tcattgctgttgtcacccttagtgactgctttgactctttaacactcctcagcagttcacccaaaaaatctcattctgaccaccatcatcatcagaacatctttctctctaagataaggaacactggaattcttctgtttatgaacaaactcccatctttctacttcctccactcccatttaaaaaattcctttttgaaccattttttaaaattgtggtaaaacatacataatataaaatttaccattttgaccatttttaagtgtacggttcagtggcattcacattgttgtacaaccwtaaccactctccatctccagaacatttttttcatcttccaaaactgaaactctatgctcactgaacaataacaccacattccaaagttaattcttttttatattctctaaggatctgtttcagatttttcccacttatacttaaaacttcaaaccaatgcttatttctcttaatctccgtctctttcagaacctacattacaaagattgaagccattttataagacccttaagttcacatccctagaccttaaaacttcacatcttctctcattctctcactagttcctcctctactgc

SEQ ID NO: 569 - DNA, 599 bp, Homo sapiens
caaccataaccactctccatctccagaacatttttttcatcttccaaaactgaaactctatgctcactgaacaataacaccacattccaaagttaattcttttttatattctctaaggatctgtttcagatttttcccacttatacttaaaacttcaaaccaatgcttatttctcttaatctccgtctctttcagaacctacattacaaagattgaagccattttataagacccttaagttcacatccctagaccttaaaacttcacatcttctctcattctctcactagttcctcctcyactgcaggaagaagtgtgcctcctccttttcaaagctgatccttccacttgtgttctttccccctctcttctgtatctcctctggaaatattatgtaagttttcctcttttcattggctactttctttctgcattgaagcatactcaagagtctatcacatcccaatataaacctcaatattaatgacaataataataacaaacatattgagtctctactgtgcaccagctactgtgctaagcgctgaaaatatatcttctcatttaattctcacaacaacctaatgagttaaattatg

SEQ ID NO: 570 - DNA, 599 bp, Homo sapiens
gccaacatggtgaaaccccatctctataaaaatacaaaaaaaattggccaggtgtggtggcatacaccttgtagtcccagctacttgggaggctgagacagaagaattgctttaatctgggaggtggaggctgcagtgagctgagatcgtgccactgcactccagcctgggcagcagagggagactctgtctcaaaaaataaataaataaataaaatgaaagtgctacagctaaaataatctctgtttaggatctgacggtaggaaaaagataagctcccacacgttctaatgcatttawgtagctccatctgcattgcctcatacatcaatactgtcatccaatgttgcttaatccatgtgtgtgtgtgtctatataagtagaactgggatgtaactgccttaaatactacaattgctgactacaggaaacctcatcatctgagaccagcactttataaattaggtgagtatcataaccagtgtgcagggatatctgctgtatatcattgggaatagcagcaaaaaagaacaagtgatgttcctattgccatatgttctgaaatatttctgatataaaaataggggagtaatgagtca

SEQ ID NO: 571 - DNA, 599 bp, Homo sapiens
tgatataaaaataggggagtaatgagtcaattttagtatgaaaaaaatggtgaaaagagtgatcaaggcaaagaatttgcaggttatttgaagaaaatactttttcagaataggatttgaaaatatttcctgactatgcttttgacttatcatgtggttctataaagggtgttgactttctctgtgtcaatgactccattgtaaatgtggtattttcagcttctctatcttgctcaattatacaagccaatactggtttacagcaaagttcttccaagtgcgttctctcaaactagtccmtgagggtgataagacgggagaaaaaggttatgagatcaaataactactgaaaacaatagttaaacaaaggtacccatgagtcttcaataaaggactatcaacaccttttctatgctaacatgactctgactctcctagagatagaatgtagattggaacatttcccatatttatttgaaaatataactttttgttaaaatattctaagattattaaaaaaagtaacttttttgaatgaccaggaattgttttttctaggatataagtatctttgggtagaagagaaaacaaacaacgtc

SEQ ID NO: 572 - DNA, 599 bp, Homo sapiens
taacataatgtatctacttatttgctctatactaaagtataacaaaacagtctcagaacttcagtaccagtatttccactatctacaaaaagagtccaactttgtaaaatagttgaagagatttattctgagccaaatatgagtgaccacggcctgtgacaaagccctcaggagatcctgagaacatgtgctcaaagtggttggtgtgcattttggttttatgcattttagggagacatgagacttcaatcaaatacatttaagaaatacattcatttggtccagaaaggtgggataacytgaagcgtggggtggaggggttcagctgggagatgggtaagggataaaagactacagtcaactgggatcaataaaaaggaatgtctgggttaaaataaaggattgtggaaaccaaagttcttatttgcagaggaagccttcaggttgtaggcttcagagagaatagattataaaatgtcaattctaatacagtggtatttgtgtatctaaacatatctaaacacagaaaaagtaaagtaaaaatatggtatgaagatttaaaaatggtgcacttgtattgggcaattaaccatgaatgg

SEQ ID NO: 573 - DNA, 599 bp, Homo sapiens
tgaaccaccgcacttggccagaaagcatgcaattttaggatctgtttttcatatgggagtagtaacacaaaagtaagttaatggagccttggtgaacaggaaagaaaatggaggataaggaatgatggtggggactggcataaccttgtccttcatgctcctttccatttctctgtacatctttaaggctagaaaagaaagcagagttaatatcatttctgtctcattctgtcttccctgaggctgtggcccacccacactgttctttggtgaccagggaaagcactaatttgactgtgstttctgaacaaccaggaaatcacagcagaaccaatccttttacttgtagctgagtcaaaatgctctctgtagaaacagtgactcagtgactttgcatccctaaattgcctctcataaaaagtacattttctttgtacctcaggaagtatgggctctttatagaaactggaatgagggagtgggctagagtttatgccagagttggtggtattgatacaaaagttaaaatgtaacccctcctttaagggaacagtggccctaactacttacctataccatttagaggacagtgataaaaa

SEQ ID NO: 574 - DNA, 599 bp, Homo sapiens
aaaagataattaatattcaaacacacatatttattagcctagcatgctaaaaatatgtgagctgtgggtcctaggtacctcaggacagctgattacaggaacactcctcacagaaggaagggacagaagaaaatgcacagggacttttaggaagataagttggactggaggtcagagactgacccagggatcatccatgagtgtcagtcacctatcctggatacatgtgtaaatttcggatctctacctgagttggaggctgctttaaagttgtctcaaatggattcctctccaggagasatgcctgctgagaactcaaaagaacgttcctgataatttctaaaagattcaatccttaaaacttgtttccaaacagacttataaggaagctgatttttgaggcagaggccttaaaagtgtcatatacaagtggcatcattttaagtccaaagtgaaacccttgattttaataagctagtttattaactaaagctgttttcttatgttacagtatttcagcacatttcattcaacataaaaagaatattaaatatccctggttgtgggagagtgtttatttttctcaaaattatctagca

SEQ ID NO: 575 - DNA, 599 bp, Homo sapiens
tatcatcatatgagtggtattatccacttgtattataactcactattatgctctttgaaatgtttattgccatttaaaaaaatagcctaaatcctgaaagaagcaggtgtcttcagagagaaaagagtaataaacggtggtaagcataatcatcttgtatgcctccatgactctgtgaactcacctctagagaggtgcctgccttctgcaagtcactggtccctgccctctcctacaggtaggcagtttggaaacctgccccagctgctgcagtcatatcagacttgttctctggcttayagccatgaagacacaaccacagccttcatggtattctccactcctgatcttccagcttaatatctggactaacaagaaacttaggactctgaccagatgtaaaattaacatgttttggaagcggcagagtaatgcccaaccaacttttccccaacatggggcataaacattgtaacatccagtccaaatgtcaatccagttttctcagagataactgctctaatataagaatgtgtgcttgtacagagtttgtgatgtgaatatgtaaattttatttatgccataatctcactacagta

SEQ ID NO: 576 - DNA, 599 bp, Homo sapiens
cagagctggaagaggcaagaagctctctccctgagagcctccagagggaatcaaccctgctgactcttgactttaaacttctggcctccagagctgtgagaaaacacgtttctcttgttttaagacccccagtttgtggcaattaattacagcaacccttggaatctaatatattgaccattccaaatgctggggaagaatgtggaggaactggaactcttgtacattgctgatgggaatgtaagatagtacaagcgctttggaaaccagtttggcaatttttttaaaaaagttaaacasctgctgcaggatccagccattctgctcctaggtatttacccaagagaaaagaaagctgtggtaggcaaaataatggcccctgaagatgtccatgccctaatccctggaacccataaacatgttaaattacatgacaaaggagactttttagatgtgattagattaaggatcttgagatggagagattgttctggattatccaggtgggcctgatgtcatcacaagggtccctataagtgaaagagggaggcagaagagtgagtgtgagagtgacatcatgtgacaagacttgacttgtc

SEQ ID NO: 577 - DNA, 599 bp, Homo sapiens
catgtgtttatttgccatcttgtttggtgaaatgtctgttcaaatcttttgcccattataaaagctgggctgtttattttcttattattgagtcttgagagttctttatgtattgtggatacaagtttttgtttttctttaattcagatgtgtaacttgcaaacattttctctcagtccatggctcacatttccattctcttaaaagagttattcaaagagcagaaggttttaattttgatgaagatcactttttcaatttttttatggctcatgcttttgatagtgtgtctaagaacaycccgtttgcctaacccaaggtcacaaaaattttctttttttttttttttttgccattgatttatctttattatagtttaatggaacaatttgataagaagacatatctaatatagcttagatgaacagcttatacaggttcagtatcccttatctgaaatactttggaccagaagtgtttgggcagattttggaatattcgtattatgcttatcggttcagcttccctaatctgaaaattaaaattcaaaatgctgcagtgagcatttcctttgaacaacatgttgggcctcaaaaaat

SEQ ID NO: 578 - DNA, 599 bp, Homo sapiens
attcccaaacgttcttctagtactttgccactctactgtcaagaggtaagagtcgctgtcccctctccttgaattggggtgagtttgggattgcctggagcaatagagtatggtggaagtggcttccatccataggtgacttccaaggctaagtctgaaaagatggtgccgcttcctccttgtgacctagaaaactcactcttgaagcctacagcctccatgtaagcaatttggccaacctgagactgccatgttgtgaggaagcccaaactagcctatgcagagtgactgcacagagarcccggagactccatgcagagagagagaggctcaggaacacccagctgccccctgctagcccagcaccagctccatttgactgtaactgtgcaagaggctgtgggccagatccaggtatcagagacctcggcagggccttggacatactaaaagcttgtagagtcctgagaaggatgttagtgccgaattaagaaaaacgttattagaaactggaagaaaggggatctttgttatgtggtggtggaaagtttgtcacctgcggtaacatagaaagaagacatgtatccagtgaactcact

SEQ ID NO: 579 - DNA, 599 bp, Homo sapiens
tttgcaaaatttgcaccacacatcctttaaatcagtaaaattcatcacacaaaaaagtatgtatgtacatgcatacatgtatacattttttaagagatgggagcttgctatgttgctcaggctggtctcaaactcctggcctcaagtgatcctcttaccttagcctcccaaagtgctggggttacaggcatgtatcactatgcctggcctacaatttttttaggacagctggttgctactagcctgccactgatcaaaacccaccactgaaagaatgacagttttcatttactgagaagktcgtgaatgttggaaaataataatagctaatattcattgtgtgctgttctaagccctctacatgtctcatcacatttaatcctcacaagagcctgcgaggtgggtactattattaataccattttcaagatcaagaaactgagacacagaggggtagaataacttgcctaaggtcacagagctgaaaaatgacagaaccaggatttaaagtcatgaagactgaatccagagtctgtgttcttagctcctgctctgtgctgtttctccaagggtaacgtgctatcttggaaaggcataaa

SEQ ID NO: 580 - DNA, 599 bp, Homo sapiens
tttgtgcagcccttaaaacggggctctgcttcatcgaatctcagttttgtgaagctctcctgctgagcccggcctctgctccagattcatccgtatgggcagacctcctaaagacaggttcagtccaaggacaggttcgaggtcgaagatggggttcagagctctctctgagggcccatgctctctagtttcctatttgcaggcacaccttttatgaacagcttggttctgggctaaaaatgcgtgggaaagagctgaggccctaaattcaggcagacctggcttcaagtgctagcccarcaataactggcctggtgacttgaacttctgtgggtctcattttcctgtcctgtaaaatggggatagtagcagaaattgtatatttggaagttaaatgacagaacatgcaaatctcttagcacagagcctgacacaatgaaagtaattcatttttttaaaatagctttttttttttttttgagacagggtctcgctttgtcacccaggctggagtgcaatggtgcaatcacagcatactgcagcctcaacctcccaggctcaagcaatcctcccacctcagcttcgtgagtagcagggac

SEQ ID NO: 581 - DNA, 599 bp, Homo sapiens
ttgctcctcatagggaggctgttggagagagagagaacacggaaggctccgggtggatttgtgcagcccttaaaacggggctctgcttcatcgaatctcagttttgtgaagctctcctgctgagcccggcctctgctccagattcatccgtatgggcagacctcctaaagacaggttcagtccaaggacaggttcgaggtcgaagatggggttcagagctctctctgagggcccatgctctctagtttcctatttgcaggcacaccttttatgaacagcttggttctgggctaaaaatgygtgggaaagagctgaggccctaaattcaggcagacctggcttcaagtgctagcccaacaataactggcctggtgacttgaacttctgtgggtctcattttcctgtcctgtaaaatggggatagtagcagaaattgtatatttggaagttaaatgacagaacatgcaaatctcttagcacagagcctgacacaatgaaagtaattcatttttttaaaatagctttttttttttttttgagacagggtctcgctttgtcacccaggctggagtgcaatggtgcaatcacagcatactgcag

SEQ ID NO: 582 - DNA, 599 bp, Homo sapiens
acccggagccttccgtgttctctctctctccaacagcctccctatgaggagcaactgtagggaccgagagacaatagcaggctgggccatggggagggatttttttcccgggatctcagtggagatggggaggtagagtgagggaaggaagcagccaggcagagaggcgcggggctttattaattaattgagggagagacgtaatggagggtggaatccacagagggaaagcgggctccatctcgagtttatgggtcatttttctggtggcagttcagttgccccagagaggatagcacmtcggtctgtcgcctcctgacaagcactaggggccctcaaggcaagtgggatgtaccccacttctggcctgcaatagaaagaactcccttcccggattccaggcgcgctggctttggccacgtggaatggtcatggtgggctgcactgggaaccacattgcaggttcgaatcccaactgcactgtgtaggagctgcgtgaccttgagtgaattggttgacccttctgtgcctcaatcacctcccctgtgaagtgggaacaacagtaccttcctcgtagagttgggacgaggattaaatgc

SEQ ID NO: 583 - DNA, 599 bp, Homo sapiens
gcagaaaactcaagattggacagtgactttctcctaggacactatcttgccggtgccctcacctcagtctccaccctggatctccgattttgtccctgaaacttcaaattcttttccttcaattatacaatgcagcagctctcctttcagtagtgctactttgtaccctaccctggggaagaggtagctcatattcgaacctgagctcttggcaaggtctttttccagatctaaggcagttcccttcctaagggagagtcagatgccactgaggagagagaaaggtagtcggagggaatrttatggcagacactgtggttgctcactaatgtaacatcccttctcttcttccttgctgtaaggactctaatcttgttccgggatttaaggaaggtgggttcagcctctggcttagaggatgggcatgtaacccagtctgaccagcaaggtataaaggtcaatttatgggcagtctgggaaagtttttcttccccgataagaggaaaacataaggggatctctctgctctaagcctccaattacttccttctccaaaagcagttatgtgaggatgtgatgcctggagctgtggaagccat

SEQ ID NO: 584 - DNA, 599 bp, Homo sapiens
tcgaacctgagctcttggcaaggtctttttccagatctaaggcagttcccttcctaagggagagtcagatgccactgaggagagagaaaggtagtcggagggaatgttatggcagacactgtggttgctcactaatgtaacatcccttctcttcttccttgctgtaaggactctaatcttgttccgggatttaaggaaggtgggttcagcctctggcttagaggatgggcatgtaacccagtctgaccagcaaggtataaaggtcaatttatgggcagtctgggaaagtttttcttcccygataagaggaaaacataaggggatctctctgctctaagcctccaattacttccttctccaaaagcagttatgtgaggatgtgatgcctggagctgtggaagccattttgtgaccatgaggagaaagccaagagaataacagagacactatcccaatgtcctgagtattgttcagctatgaaactaaccctggaaactccttgggccacatagtagatattttaagttttgccagccatatgtctctgtcatgactactaaactcttcatttatatcgtgacagcagcctttgacaatat

SEQ ID NO: 585 - DNA, 599 bp, Homo sapiens
ttacttccttctccaaaagcagttatgtgaggatgtgatgcctggagctgtggaagccattttgtgaccatgaggagaaagccaagagaataacagagacactatcccaatgtcctgagtattgttcagctatgaaactaaccctggaaactccttgggccacatagtagatattttaagttttgccagccatatgtctctgtcatgactactaaactcttcatttatatcgtgacagcagcctttgacaatatgttaacaaatggatgtgactatgttctgagaaaacttcattttcaraaacgggctaagggccagatttgccctgtgtgccactgtttggcacaacctgtatttttggccatattagctggatttgcagttacttgcactcaaagcatttctaacagagcatgtatgggctgccctagagggcagtctctcaccccaaacacagctgtgctcacaggctcaattgccacttgctggaagcaacagcttattttcttctgtctaccaacattcattcactcaacaaacgtctattgagtgcctactctgtgtcaggaactgttctgatgctggggctaaaataggag

SEQ ID NO: 586 - DNA, 599 bp, Homo sapiens
ttttttttgtttgtttttgagacagagtctcactctgtcatccaggctggagtgcagtggcgagatctcggctcgctgcaacctccaccttccaggtttatgtgattctcctgcctcagcttcctgagtatctgggactataggcacccgccaccacgcctggctaatttttgtattttgagtggagacgggctttcacctggtctcaaactcctgacctcaggtgatctgcccgccttggtttctcaaagtgctgggattacaggcatgagccactgtgcccagcccagaaagtatttytgaggcctttgtgcagtggctttatcagaaacaaaggagcaaaaaatagacaggagcttgggctcctacctcataatcaagttttgccttgcatttgtcccagaaaattcactggattaattggacttcagcacaattgtcttaatttatagcattaagtaaaatctatatatgtcaagatgcaaagtgcaggaatgtaatggggactgtcacagaggctgctacatctgcagtattctttcctaactgcctaagaccatgggggaggacatggtctaagagctatgcaggaactagga

SEQ ID NO: 587 - DNA, 599 bp, Homo sapiens
ttattggcaagagctgtgtcttaattacccccagctgcaagggagtttaagatggtgagagtttttcttttttttagcttttcagcctgtatagtagaaagtcaagataaaggaggttgggatgggtgtcaagtggtcagtatccaccatggtccccgttccctgtcccacctctccttatcctgagttctcactctcctgaagtaattctcttcctccatttttctaaataaaatgtttattctgtaatttcttgattttttcctccattcagatactgattgtctctcaactatgaarggtaaagatatcttccctcatcactatccccacatgccacgcacatgccacacacacacacagtcttcaccacttcatattccaagtatagattggtgccatttaaatttttaaattatattttatttctactttatgtttaatattttaaaattatttaagtgacaaacagtaccttaggtgatcaagatcaacatcaatagtgataaaacatgttgataatatatgtaccattggtatgatgtaatgaaaatggcacgttaccattgtgatcttcctcctaaacacccacaacttag

SEQ ID NO: 588 - DNA, 599 bp, Homo sapiens
cattcagatactgattgtctctcaactatgaaaggtaaagatatcttccctcatcactatccccacatgccacgcacatgccacacacacacacagtcttcaccacttcatattccaagtatagattggtgccatttaaatttttaaattatattttatttctactttatgtttaatattttaaaattatttaagtgacaaacagtaccttaggtgatcaagatcaacatcaatagtgataaaacatgttgataatatatgtaccattggtatgatgtaatgaaaatggcacgttaccaytgtgatcttcctcctaaacacccacaacttaggctaatggtgagaaaaacattagacaaaccccagttgaaggacattctgtaaaatacttgatcagtactgttcaaaaccatcaaggtcatcaaaaacaaggaaagtttaagaaactgccacagtcaagaggagcctaaggaaatacatacaaataaatgcagtatggattcctggattgaatcttagaacagaaaaaaatcattagaagaaactaaggcaatcttaatcacccatggactttagttgataataatgtattgagattg

SEQ ID NO: 589 - DNA, 599 bp, Homo sapiens
aacttaggctaatggtgagaaaaacattagacaaaccccagttgaaggacattctgtaaaatacttgatcagtactgttcaaaaccatcaaggtcatcaaaaacaaggaaagtttaagaaactgccacagtcaagaggagcctaaggaaatacatacaaataaatgcagtatggattcctggattgaatcttagaacagaaaaaaatcattagaagaaactaaggcaatcttaatcacccatggactttagttgataataatgtattgagattggtccattaaatgtaacaaatttcacrtcagatagtaatgtcagatgttagtgatgggggaaactggatatggagcatataggaactccctaaactatattattaattttcctttaaacctaagacagttctttaaaaagtctattcaaatattgaattaatatttgatggttatattatgatgattgggttttgttgttgttgttttcttgttgttttgagagacagggtctcactttgtcacctaggctacagtgcagcggcagaatcatggctcactgcaggcttgacctcccaggctcaagcaatcctcccaccacagcctc

SEQ ID NO: 590 - DNA, 599 bp, Homo sapiens
cacccatggactttagttgataataatgtattgagattggtccattaaatgtaacaaatttcacgtcagatagtaatgtcagatgttagtgatgggggaaactggatatggagcatataggaactccctaaactatattattaattttcctttaaacctaagacagttctttaaaaagtctattcaaatattgaattaatatttgatggttatattatgatgattgggttttgttgttgttgttttcttgttgttttgagagacagggtctcactttgtcacctaggctacagtgcagcrgcagaatcatggctcactgcaggcttgacctcccaggctcaagcaatcctcccaccacagcctcccaaggttcagggattaccggcatggagccaccatgcccagcctgatgattgtttatattattcacaactgggccacttcgtgtgctatgactataacattttgtttttcctagagttagccattgcctctttttttttgtcttctgtgttcttatcaataactcaccccaggctctctgctattcttataaatctctcaatacattcaagaacactgagtaatttatcagttta

SEQ ID NO: 591 - DNA, 599 bp, Homo sapiens
gagcatataggaactccctaaactatattattaattttcctttaaacctaagacagttctttaaaaagtctattcaaatattgaattaatatttgatggttatattatgatgattgggttttgttgttgttgttttcttgttgttttgagagacagggtctcactttgtcacctaggctacagtgcagcggcagaatcatggctcactgcaggcttgacctcccaggctcaagcaatcctcccaccacagcctcccaaggttcagggattaccggcatggagccaccatgcccagcctgrtgattgtttatattattcacaactgggccacttcgtgtgctatgactataacattttgtttttcctagagttagccattgcctctttttttttgtcttctgtgttcttatcaataactcaccccaggctctctgctattcttataaatctctcaatacattcaagaacactgagtaatttatcagtttaatttattttttggcttcaagtgctactgcattgtcctaatactccattgtcgtaatactccctcattcagatggtagcagggttttaaaacactaaagtagttttaaatc

SEQ ID NO: 592 - DNA, 599 bp, Homo sapiens
gatatgatgacagctgtcaagagggacaaggcatttcaggtgggaagttttctagatccaaaatggggatcagaagtcacaactccaagcaccagggcttgccctggggctgacttctcttgaatcatttcctctgagattcatgttttcccataagaaccacttgaatcccctcttattagtctccctctgtcgtgagcactggccgcacccctgttcctgtgtgtaaattctcctgcttccccaagggctgtttcttggctgaggtttatcaggcatcagagcatctactccacaagktcacatgactctggcatcttcccactcatgcatttcttttttaaaaaatttttattttattttattttattttatttttgagattgagtcaggctctgtcacccaggctggagtgcaaaggcatgatctctgctcacttgcaacctcaacctctgcctctcgggttcaagtgattctcctgcctcagcctccagtgtaactgggattacaggcacgcaccacccccggctaatttttgtatttttagtagaggtggggttttgccatgttggccaggctggtcttgaactcctgacctc

SEQ ID NO: 593 - DNA, 599 bp, Homo sapiens
ttgagattgagtcaggctctgtcacccaggctggagtgcaaaggcatgatctctgctcacttgcaacctcaacctctgcctctcgggttcaagtgattctcctgcctcagcctccagtgtaactgggattacaggcacgcaccacccccggctaatttttgtatttttagtagaggtggggttttgccatgttggccaggctggtcttgaactcctgacctcaagtgattcacccgttttgtcctcccaaagtgctgggattacaggcatgagccatcacgcctggcccctactcatgcrtttccatctagccatggccaggctgcctgcagccagtgtaaaataccaatccatcttgatctatacacttttaatgagcaactactatgtaccaggcattgggcattatttcagtgtttctcaaacttcagtcatttgaattctgcttcccaggttttccaagtttcatctgtactacttttgacttaatatttttctttaaattggctccttttttgtttcaataaatttattttgaaaaggaactttagagcactgccatcagtgaaaaaaacagtagacagtaatatttttcaaaa

SEQ ID NO: 594 - DNA, 599 bp, Homo sapiens
ctcagcctccagtgtaactgggattacaggcacgcaccacccccggctaatttttgtatttttagtagaggtggggttttgccatgttggccaggctggtcttgaactcctgacctcaagtgattcacccgttttgtcctcccaaagtgctgggattacaggcatgagccatcacgcctggcccctactcatgcgtttccatctagccatggccaggctgcctgcagccagtgtaaaataccaatccatcttgatctatacacttttaatgagcaactactatgtaccaggcattgggcrttatttcagtgtttctcaaacttcagtcatttgaattctgcttcccaggttttccaagtttcatctgtactacttttgacttaatatttttctttaaattggctccttttttgtttcaataaatttattttgaaaaggaactttagagcactgccatcagtgaaaaaaacagtagacagtaatatttttcaaaagtagacagtaaccttaaaataaatgcataactattaaaataaaaacttttgctctctgtccccctagtacccaccaatgctgcatatacctggaatgatgctgct

SEQ ID NO: 595 - DNA, 599 bp, Homo sapiens
caccaatgctgcatatacctggaatgatgctgcttttcaccccattcccacaaggtgggtttcattgccatctccattctacagatgtgggaactaaggttcagaggggtgaagggacttgtccaaggaaagaggtttggaaagtggtgggatcgaggttcaaatccaggtctgtctggaatgaacaccaatgagcctcaaccacaaggcttggggtctctgaggcccagtcttggttcccaaggtgcatgcaagggtcttctgtcttcccagtggtggtatgcattgattccccaggaygatgaaaacttgctgtacccccttctccatttatccacagataaaagaggcagagattaccgtgaaagcttcctgatggtgtgagagagtcacagaggttcaatctcacatcacatgacccagctttgttctctgcccattcactaaccactatctgtactaatctctggcgggagctgattggaccaagctaggctcctggctccggctgggccaatcggattctctcctctactctctctttctctgtcctctagctgggcttgggtcaaggtgaggagacaatcagcccaaagcgg

SEQ ID NO: 596 - DNA, 599 bp, Homo sapiens
gttgccatgacttgtttaactttctacctccttgttgctctatgggatcagagactgtctgtcttattcccttctgtagccacagtgcctgtcacttggtaggtgcataataaacatttgttgaggtcctcctggcctccccacttaccagctatagaatctttggcaagtcacttaacatgtctcagccccatccattccctcatttgtaacacatggacaataatatctacctcactagtttgtggaattgcagtgaagattaaataaaaggatgatggaggaaaagcttagtaaatkctgaaatgctcaaccaaagtaaggaccctactaagtcagaatttctaaaactgtcactgcactggtttacatgaatcaatttcagatgatacccagaagcaatcttattgaactaattgcatgtttatttgaattaaaatagagaaaaaatataagcagccactcaaactcagatgtattaattagggatgcatttggtttcaaataacagaaaactcaacaagtagtggcttaaacaagtaagggttaaatgttttcagttaacaagatttttggacttcaacagtccagggttggtg

SEQ ID NO: 597 - DNA, 599 bp, Homo sapiens
ctgggatttgagagtaagtttttgccaagtacaatgctaatcacttagcgggtcctcatggttatttttttacctaaatgaagttcaggctgcaaatgtacctgttatgggttaaattgtatccccccaaaagctatgctgaagccctaacccccagtgcctcagaatgtgactgttgggagacagggtctttctagaggtaattaagttaaaataaggtcacgaagatgggtcctatccaatacaacgggtgtccttataaagaggggaaattcagacacaaagacacacacaggaagrgggtcatgtgaagaagaagatggagatcggggtgctgtttctaccagccaaggaacaccatgcactgccagcaacccagaagccagggaagcggcctggaacagatttgccttcacagcccttggggggaaccaacgctgccaatactttggtcttagatttctggcctctagaactgtgagacaatacatttctgttgtttaagccacccagtgtgtggtacttcgttatggcagccctaacaaactaatacatcactcttcttccatcttattttgttattgttggatttttttttg

SEQ ID NO: 598 - DNA, 599 bp, Homo sapiens
agtagggttagccctgcctgaaccatgtggacagagagtaggagaagggtgactaaatcaggtgctttttccaaaaggagagaagtggacaccaggcagagcacaccaagaagtgttgctgcagaaatgtagtaggggttttcccctctttttccagtagaagagatgcatcatatcaagccattctgattttctgttctcagttttctcaaatgacaaataagaggtgttgtgagcttggtgtgagaagttccaaagaattttctggaatgatggaaacattctttatctgtgctgtcyggtatagaagccacaagctatgacattgctactggactcttaaaatgcagctagtgggactgagaaactgaatttttcattttaattaatttaaatttaaatagccacacaaggccggtggctgctgtaatcagacaacacagaataaaagcctgctaagtttttctgttagcattggatagaaatgtgagatcttcaatgcatctggtctgtagtaaaagaaactctcttgcccttgtctgctgccagagaaactttctgaatctcagggagtttttccacgagagtgatgggaggtc

SEQ ID NO: 599 - DNA, 599 bp, Homo sapiens
gactggagcaggaggatcacttgagcccaggagttcaacagcagcctgggcagcatagcaagaccccatctctgaaaaaaaactagcagggcataatggtactcatctgtagttgctgctattcaggaggctgaggtgggaggatcacttgagcccgagaggctcagtgagccatgattgcaccactgcattccagtctgggtgacagagcaagattctgtctcaaaaaaaaattttttttttgaaagaatcattagcaccaaaatgttaatagtaatagcgcctgaggaggcagaactrtagtttgtgtgtgcgtgtttcaaacattttcttctttctgcttgtttggttagttttcatgttgatttctggtaatgaacattgctcttatgataagggagcaccagcctcctcctcccttgtataaaatagtcaaatggtgtgtttacattaaaacagtattatacctccaaaggggccgggtgcagaggcacatgcctgtaatttcagcactttgagaggccaaggtgggcagatcacttgaggtcaggagtttgagaccaacctgggcaacattgcaaaaccctgtatctactaaa

SEQ ID NO: 600 - DNA, 599 bp, Homo sapiens
attgaacaccagagctttctgcccatcaatgcccttgccatccctcccctctgtttggggtctgggtttactcctgtgttaaaaaagcaaaaggcccgacacacaaagggaacccacatacccgtaaggccacccagccttcttcaaacacccagccgctttgctcttggctgggattctctgggctttgggagcctcctgctaatcagaaaccctggtctgcagtttgtacgtctttgatgaataaaaaatggggaaacaaattaattattacttaataaattcagtttggttgacaamaatttttcagaacatgaggcctccaaagttggagtcagcccaggtgtccatcaacgggtggccagtgaaatggacgatgacgccttctcatggtggcatgcctgggatggggagctccgggcagtaacgtggaaaggtgggaaggtgtccggggcatcatgtctaaagggaaaagaaaattgcaggggagtttgagtttggacagcacaaactcattcttgtggatggaaaataaatgtacatgggcagggatgtaaatatgatgtagtcacagagaaaattctaaaaaaacgccaaat

SEQ ID NO: 601 - DNA, 599 bp, Homo sapiens
gacaatcaatttgaactccaaacccatgcgagtgcaggattatggttatacattctcaggggaagctaccttttggttttccaaactagaggcaaggcagagacagatcaaggcatgtcttcttccagtgttagtggatagaggtgttctgatccacatactcgctgagtgtgaaggcctcttcagtactaagatgggcacctatctatcccatgccccactcctttattgcagagggcacttaattattggttcacatacttagcagtctgagtgagttccctcttcagttttggcccytgggaatttcttactttttccagaactgacctatatatttaaagggatgctggtataccttatccagtatttctgggtgttttatagtgggagcatttcaggttatattgtcttccatgttactggacactgaagtcctctcaatgtaatgaaaattagtttctcctttagaattctttttagaaggtctggtagcctcctgcttcactggtgacctgacacttttcacttaccctggggtctgagcccactttgtcactcacagggaccaaaggctgaacaaatcctgggagtctctc

SEQ ID NO: 602 - DNA, 599 bp, Homo sapiens
tccaacagttcttcagtcttcttttgtctttaatggccttgacacttttgatgaaaactggccatttatcttgaagaatgtccctccatttgagaatgcagggtgtttacttatgattcgattcaggttgtgcattttgggctacaggagtgatgttgtgtccttctccatgcattggatcaggaggcaccactgctgttaactttggtcacttgctcaaggtgaagactggctggatcctctgctgtaaaattattatttttccctttgtaactaataagtgcttgtgtggaaacattytgagacaatgtaatactctctgtcatcattcttttgcccaataattttagcatgcatcgatgcttcttgcttgaaacaattattgctatggtgtttgccaaatggtgattttctgtttccgtcattacttctacatttattaattgaagagcttttttccttcttccccatttatttatctattcagttttttatttatatcagtgtggactcagattcatattttaatctgtttcccctctctctctgccacctccatacccactgtctctacccactatcttttctctctcttcccc

SEQ ID NO: 603 - DNA, 599 bp, Homo sapiens
ggacgtgatggcatgtgcctgtggcccccagctactccagaggctgagacagaaggattgatcgcttgagcccaggaagtcgaggctgcagtgagccgtgattgtgccactgcactgtggcctgggcgacagagcaagaccctgtctctaaaaagaacaacaaaaaacactcacaggttctgagggtcaagatgtctttgaggagccattattctgcctgccacagagatgcccccatggaaaactctcaaactctgtggcgccctaccctctcacccagagctctaataatttcatcayttatcacacatttcaaacaacccacgttaattgagcacctactatgtgaagagccagagcaggacccagggaaggaagggaagactcgggaatgaaaaacaagattcccttggtgttccatggctgtcaggttctctgagaaacgttttccaaacattttaaagattttttgtcatttctctctctttcaatttgtgtttgtaagagcagccagtgacatttagctgatgcatcgaataataccattggacaaagtaaacgggaggccctcaggtttgccaagctgcccggcagagcat

SEQ ID NO: 604 - DNA, 599 bp, Homo sapiens
ctgcctcaccctcccaaagtgctgggattataagcataagccactgctcccagccttcacctgcttttttcactcaatattatgttattaggattcacacaaagggcacggtagctcatacctgtagtcctagctactcgggaggctgaggcaggagaaccacttgagcccaggagtttgagaccacagagagctatgatcgcacctgagatcgagccactgcactccagcctgggaagcatagcaagaccacatctctttttttaaaaaaaaaaaaagattcatatctgattttgcatraggacttcctttttcactgctgcatagtgttccattgtgtgatcatcccactatttttttttctagagatggatgtctcattctgtcacccaggtcggagtgcaatcttggttcactgcagcctcgaattcccaggctcaagcaatgctcccaactcagaccctgaggtacaggtgtgagccaccacgcctggctaatttttgtattttttgcagagactgagttttgccatgttgcccaggctggtctcgaactcctaaactcagacaatttgactgcctcagcctcccaaagtgctg

SEQ ID NO: 605 - DNA, 599 bp, Homo sapiens
cctgagtagctgggactacaggcacctgccaccatgcccagctgatttttgtatttttgtaattttgtacagaaggggttttgccatgttggtcaggctggtctcaaactcctgacctcaagtgatccgcctgctttagcctcccaaagtcctgggactacaggtgtgacgcactgtgcctagccttggcttcctattctgggagagcaggggaccccgccacctctactcacatcccttcccaggccgtgcatggtcccacctcctagccgctgcctgtgccattccttccacaaggarcaccattctccatcttctctgcttacctctatcctacctgtggtcaaatccttccatgacaataaaatctacaaccaaaacaatcagacattggggaaatgcaaataaaaactacagtgaaataccacttacacacccaccaggatggctagcgtcaacaaatgggagataacccatgttggtaaggacctggagaaacagaaaccctttgaacttcctcagtaagttaaacacaagagttaccatatgatctagccaactgtactcctagatatatgttcgaagaactgaaaatgggg

SEQ ID NO: 606 - DNA, 599 bp, Homo sapiens
ccaagcaagaaattatagcaaactgtgacaatatatattcaaggtgctattagaccccaaaagtctaatagacctcagggaagggacatttaggactggatcttgaggaatgcataggagttcaagattagaaggaaagtcctcaggatggcaagaccagcctgagcaaagacataggggcttagagaggagcctagatgtttgtgaaggggagtgagggaaatgctgtagctccagttggcagggacaagggagttcagagccttaatcaccaagacaaggtgatagacatttcttgcrcaaggggcaatggggagccattgatgattctggagcataggagtggtctgatccgagtgaccaactcacccacgacagagaaggaaggaacccatcctgggctcaggatgtctcttctgaaagtaaagccgttgctcccttttcttccagctgtcatacattttaatggttattttaacaagtttccagcaggtggcagttgaatgcctcaaggaagaggcatctttttctaatgtgctgggattaggtgtggccagtgctgggattcctagaccccacaccatgcttgccaacccatt

SEQ ID NO: 607 - DNA, 599 bp, Homo sapiens
cactgagcttcccacaccctgtccccttccccaaggcctcttatccacttccaccatgctgtcagcaaactcagatcccatactttgtgtgtgcctcacatttcacaggtctgccctggctcaatgcgttgttggtcacagtcggagagaaggtccctgagcctttgacccacggcatggggaaatgaatgcctggtcaggtcagggactcttggttgtgtgatcctggggaagctcctccctgctctgggcttcactcttttcagggagacagggcttgtggaccttggagagtagatrtgtggtgcccccagaaagacacacacacacacacacacacacacacacactcactcttccatggaaggcatattgcccattagaatagatgtgtggtgcccccagaaagacacacacacacacacatacacacacacacacacaaacacactcttccatggaaggcatattgcccattccctctgcctgggcaatcagaacggtctgtgcccctggctatgatgaggggttcaaggatagacatgtgacccatgcctggccagccaggctcagacctgagaccctgttaagtgggagga

SEQ ID NO: 608 - DNA, 599 bp, Homo sapiens
ggagtgcagtggcacaatcatggcacactgcagcctcaacctcctggactcaagcaatcctcccacctccgcttcctgagtagctgggactacaggtgcatgccaccactccaggcaatttttttgtttgtattttttgtagagacagggtctcactatgttgcccaggctggtctcgaactgaactactgacctcaagtgatccacccaccttggcctctcaaagtgctggaattacaggtgtgagccactgcaactggccagatatgccacctttggtttatccatccatccatccaytgaggaccgcagggtgtctccgtttgggctactgtgaacacccaggcatctttgtggctgggaacaggagaggtgtggagagcagacagtgagtcagaagaactaaaaagggaaatttgggaactagaactgggctttggccaccgagatcaagtcctgattttacctccaaaccgtgtcttgaatccatcacttctccatctctgccaccacttccccatcccaggccaccactatctctccccaggtcggttactgcagcctcccttccggcctcccttctgccactcccaactccc

SEQ ID NO: 609 - DNA, 599 bp, Homo sapiens
tgggcttttctcaggaggttgggaagatgtggcaggacccacaaaggaaatgagaagatacagccagtgacataggagaaaaaccaggagaagccaattgcaggtcacgtatctgggcttgataactatggatgtacccttggcgggcttctccccacattggaaggcaggtccaggaaggcagggggtttggtctgccttgttcaccgctgtgtctcagcacctggcagtgcccaggacatagcaggtgcttggtgacgaggatatgagtcagtggctgacctggtgtcccctggcccygctgtttggcatccagatctcagtctctggactgatggcagtgatgcccctcttcacctagccaccagcaggggcagatggtggtccaggtgggatctgaggcggagcttccttccaccatggccaccccacccaagaagtgggctgagccagccacccacaagagggaaccgaaatcatcctccaccacaaacacgctggcctggctccacactgggcaggacatggaggaagggggagcgatagtgagggccagagtccctccacttcaagggtccccttcccctggtatatacatg

SEQ ID NO: 610 - DNA, 599 bp, Homo sapiens
taatcccagctacttgggaggctgaggcaggagaatggcttgaacccaggaggcagagtttgcagcaagctgagattgtgccactgtactccagcctgggcgacagagcaagtctccagctcagaaacataaaataaaataaaaataatagctaatgtttaccgagcacttgagggttttgcttcttaccatgacactgataattaggaaagactttactatctctattttaaacataaagaaaccaaacagagaggtgacgcggcttgcctgaagtcacacagcgagcaagtaaacccsagcttagaatctgagtagctgtgcaaccttgggcaagtcacttcacctctgtgagcctcagtttcctcatctggaaaatggagatgataagggttgttagaagaattcagtgagcttcatggcccatgaacttgtcactctgtatttaagggtatttaacttgtcactttgtatttaaggattcactttccaactgcctgtctaccatgagaacaaacaccatgtctgctgtgttccccactgtatccccagtgcctggagaagtcctagcacatagtaggggctcaacaaatctcaag

SEQ ID NO: 611 - DNA, 599 bp, Homo sapiens
aaccttgggcaagtcacttcacctctgtgagcctcagtttcctcatctggaaaatggagatgataagggttgttagaagaattcagtgagcttcatggcccatgaacttgtcactctgtatttaagggtatttaacttgtcactttgtatttaaggattcactttccaactgcctgtctaccatgagaacaaacaccatgtctgctgtgttccccactgtatccccagtgcctggagaagtcctagcacatagtaggggctcaacaaatctcaagttgaggggcagtgtattctcttgamcttatggggccctaactcctctcagccttcctctgctgcctggtgctgcaaacgtccaaccccagggccattccagtcaacccaatagatgcaaacaggaccatcccagtctcctgtttcaggtatgaggagcccacaaagcacatttgggtgttatgattgctaggaggacccagtgctgttctctggccattgccaagtggctaaaagctgcacacaaacaggcttcagccaaaaagaaatgactgacttacagagctgagaagtccaagagtgactgctttcaggtatggctggat

SEQ ID NO: 612 - DNA, 599 bp, Homo sapiens
catcatttatctcagtctagatccagaacatttcatcacccctaaaggaaaccccatactcattagaagttacttcctattcccgctgcccatagcccatggcaaccactggtctactttctgtctctaggggtttacctattctatatactttacataagcagaatcacacaatatttgtccgtttatgactggcttatttcacttagcatgatgcttccaagtttcatccacattgtagcatatatcaatgcttcggtcctttttatggctgtgtaatattccattgtatagatagcrttgtcttgattcattcatcccctggtgggcacatgagttgtttctatcttttgcctattgtgaatggcactgctatgaacattcatgtacaagtatctgtctgagtgcctgttttcaattcttttgcctctgtactttagctaacatttttgtttgtttagagatgggggtctcactatgttgcccagcttggcctccgactcctgagctcaagtgatcctcccacttcagcctcccaaagtgcagggattacaggcatgagccatctcacctggctttagctaacattttgatgcttt

SEQ ID NO: 613 - DNA, 599 bp, Homo sapiens
ccagcctgggcagcatagtgagaccctgtctctaccaaaaaaaaaaaaaaaaaactgggtatggtggcacatggctgtggtcccagatacttggaaggactgcttaaacccacaaggtcatggttgcagtgagctgtgatcatgccactacactccagcctgggtgacagtcagacctgtctcaaagaaagaaaaaaaaaaaaaaatcctccccaagcctcagcaggggaattcctaccatggataaaggctttctctgcatgtgggcctgatcattaaaaggaaaatttcagcctcccraattatactattatccagggtgattagatagaggagaggctgagaagccctgatctcagcggggcatggattaaggggaccccacagctcagccaggttcccagcgattcaaggtcctgcgatttctcaccgacttggtggctccagggtgcctggggctggctgtgcttcttggggagcaccaggtaccactgctgcttcgaggccctcaatagccctttggtggacccggttgtgttctgagcttggggtcctgagatgcagacaccccccagccccagctggtgggcgtgcagcta

SEQ ID NO: 614 - DNA, 599 bp, Homo sapiens
ccaagactcctgttctctgggagccctgatggtagggccccatcagattccctagggcttttcccaatccagggaaccagggaggtcccagagggctttgccgtagccctggctggctggggctctgtcacaggcttggtggttgctgcggggcctggggtgttgcctgcaaagcaagcagccctggggaggcttctcctagcccctcggagcatcaggtggaacagtccgggcggctcaggagcatcccctcagtgaatctgtgtccaggtgatgggccaagggtgctcagaccacaaytcttgcatgtgcttgccaggtagtcaactgtgatccctgacctctgacccaggggttggctctgggaacagttttaaacaaaaggaaaagaaagttctgacaaccagtgggtggtggcgaagggcttaagctttggatctgcacttgcggtctgtcacttaaagggtgccctgcaggagagggagcagatgtaatcccagtgccagcctggtggaggccctgctgcccagggctggaagaggctttggagggagagagccaagagaaggcagctgcccagaagtctgaggccaggtggg

SEQ ID NO: 615 - DNA, 599 bp, Homo sapiens
gaaggaggtgagagagactttgcttctgagggccccttctgagcccttctagtcttctttagttcaagtacgtagcatgccacagcacctttctttggggtgttgttttctgagccccaacattcatggccctgaatgtgtgcctctgtgtgccaggtgttgccctaaattcttggaccttcccatgagctggagttcactgacccatttgacagatgaggaaactgaggcactgggagaagcaaagagacttgcctgggatcatgaagtgaaggggatctgaaccctgagacaggaacycttgatcccaaggggcccctaaccccaagcccttggccccctgctgaactggttcaaaccagagagtgtataacccagctccaggctgggctgggcctgaggtgtgcgtctcacctggcagttacaagaaaaggaaattgcactggttgccacatttacaacctaaagtggagagatttcacagaatccagacttctggtttctcttatggaatccggggatcggccgggcacggtggctcatacctgtaatcccaggactttgggaggcgaaggcagatggatcacttgaagtcagga

SEQ ID NO: 616 - DNA, 599 bp, Homo sapiens
acagtgccatcaataatactgacagtaagtccttctaaggactcactgctcacaggggcagccaactgcccaggttccaagcccctctcagccacaggggctgtgagaccttgggaaagccacctaagctctctcagacctagtctccccatctgtgaaatgggcctaatggcgcagctaccctcacagggctgctgtgaagataaaatgaagccaggtcagtaaagtgcctgctgtataaggaaagcccaataaatggtggtttaaagggcatttatcaacagctagaactccatcatrtcctccactgtacagatgagggaaactgaggctcaacctccagaaccaccagggctggcaggacttcaagaccatctcagctaatccatgcctgggcatatgtggaaactgaggcccggcaggctgggcatgctccatttgaaatgggagccccacctccccgggaaggtctggggcccaaggccagctactccagcctagcagctgcttctggaatctttctccttccccagggcccccactgctgtcgcctccccgtcaggctctactgctgaaccagtggcagcacaggccaggct

SEQ ID NO: 617 - DNA, 599 bp, Homo sapiens
catttctgtgacttcctcttggaaaactttttgaaaaatgttgccggcctgtgaattccacaatctggaaactgctggtgggccacccaggctccaatgcctggcacacagcagatgctcactaaagggtggtgtggggtctgtgagcgtcatttccagccacagtcaagcccctgttgtcttctagcctggggctgtgccttctgccctctgggtgttggctcttgctattcccttaacctccagtgcctttttctccaccatccccacttcggagaatattcagcaaacgctactgcycctttctctgtgctgggccaagaccgaaagatggaaaaggaagagggaggccttcttgagcctctggtgcatgggagcaggggagtgacaactcaggagggctgcccagggaggggccttcttgctcccaagtctctcttaaggctgagctcctaaggccctgtgctcctccctgccttaccattcccctgagatccttccataccctctgggagctctgttgcacacactatgctcatattctcagggaagggtagtggcattattatcccaccttagaaaatgcagactcttgcttg

SEQ ID NO: 618 - DNA, 599 bp, Homo sapiens
tcattttttcacaaggtgagctaacacaagcgaaaggcatgactcgcacagctgttaacaggccggtgagtaaagcctgcttggctcccactacactactgacagcatgacagtcccctctgagtagcctagccactgggtacacccccagcttctctcagccttacagaactattgccccattttgtcacatgctcccttaccatcctgcaataaattccacgtaatataaccaacatactaccctaactaattacaagacagggacaacaaaggactgtcacttagccgaaataaaamgtgcttcagtgcaactgtagacaacacaaccaactacttggctgcttctgagtttgttgtgaaaagaaggctaagaacataagggagccaaagggcgggggagctaggaaagccagcctggttccagatccacccagggtccacatggaaatgcagttccaggctcccttcaaatggccctgtgctgtgatcagtccccctgcaaaggtctctgagccacagtcccgtcatctgagaagtgaagatgaaacaccagcctcgtggggtcacgcagctctccctgactcccgcctacctga

SEQ ID NO: 619 - DNA, 599 bp, Homo sapiens
tgagcacaacccaggggttcttccccaactccccacagcagcccttgagagccgcccaggcctagagccacaatctcaacccaagcctgccaagtatcagagccggggtccgccacagctacctggtggtatgggtgtcctatgccagaggctccagccaggttgcagcgtgtgggcacatgggcgcaggacaacccctgcttcagtcgaaacctcagcctggacagctcaggctctggccactgcagggaaggaccaccagatgcccatcagattaagctatatggggggatgggtgakaggggagacaagctcaaacctgggggctgtgtcagcagctgtgggggctttaggttccctcctctcacatgcccgctattccacctccctcaaaagtcaagccaggccagcaacagctgctccctggacctgcttaggctctactgtggttgggtgatcaaagtggccagatcatttcaggtatttgtggtttgaacagtagactgtcacccaccacatcctgcagcgtctatttctggggagcaagtcttctccattcccagcatctaaacagatggcttctgtttgttatggccact

SEQ ID NO: 620 - DNA, 599 bp, Homo sapiens
ccaggtccaatgggctgggagggctggccttctgccagcacatgcttcttgggatctcagtgtgaatggtgttcaggaggctaggggaaggcaccctggacctcactacaggctcagagcctgcccagcaacaccatggatactctctctaaaagggggactcctggggagactatagacaaactcaggcctggctggaagaaagagcatcaggaacaagccttgagtaccccaacttggtctcgtagagttcaaggcccaagctacaagcagcttgctccagcatccaggaggtccggyggtgcacacggcttgagatgcctgacaacctttacacctttgtgctgaaggtgagtgacaaggcttttcacaccctggggcaatacaaatacatacacatacagcagacccaaccctgttcccttcctccctgccaggtgaaggaccggacagacatcatctttgaggtgggagacgagcagcagctgaattcatggatggctgagctctcggagtgcacaggccgagggtgaggtcctgggccctcgtccctggcaccacctttgctgctaccacccctgacctgcccagatccttaa

SEQ ID NO: 621 - DNA, 599 bp, Homo sapiens
aatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccragaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacc

SEQ ID NO: 622 - DNA, 599 bp, Homo sapiens
cttaaagaaaaatgggaccacctgggtgcttccagcttctagttacactgcaccaatgtccaaggccaagccctctcaagagtacaacttatggtcaaagcagatatatggataaccagggaaaacaattggagagatgtgtctggaactcatgtgagtaacaatcaagttgacaggccccggtagtcacttcggagagctgagactctgtgaaggccatcatccctgcctggcttccaaggtaagtgtgtaggggaatatatatgtacacatatatatagtagtgaggctatatagacrtagcaaagcagacacagaaaggaaagaaggactgggttgcattccagagtcaaagatatttttaaggtctcagttggaaaactaaaggactgaccaatcagcaccttcactgatcccatgacaaaaccacacaaacattcccttagggccagatcacgtgtatttgagagggaaagggagacaggcaaatggcatgacacacagggtttcctagctgggagagcctctagctgcttactgataaccttcacattctacttggccttcacagaaagttggctaaagctggtattacctga

SEQ ID NO: 623 - DNA, 599 bp, Homo sapiens
ttgctaatggaggcagttaaagatgtctttgatatctatcagttccctggggcagtagtcttttttgactttagtatgtatgctcagaagtttctaactgccagactgagaatcaggcttctgtaccctagaaaggagttgtccagatgggaggcacctccagccttgctcttaccaccctgtacattctcctgtactttccagtgaccctcatcataggcccaagtgtgcaaagcttagctttgtgggtatcccttggctgcttttcattaaagaagttttcctctcaattctttcctrtcgctttgcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggtaataccagctttagccaactttctgtgaaggccaagtagaatgtgaaggttatcagta

SEQ ID NO: 624 - DNA, 599 bp, Homo sapiens
gtgtgcacctaaaatgcacttgtttgagtagtttctgcctatgccttcaagttgcctttttgggaaaacctagtgaccgttaagagtaaatgcaaactaatttgattttaatatcatatgtagagctgtattatatgaaccaaatgctagtctgttaagcaatagctacacttattttttcaagacaatggatggtttaaatggagtcatctatagaaattggtagtggcgtgagttatgcattgtaaccatcaagaaagttcagttgatgaagtgtagaggagcgatggaggttgtcasacatcggttgtgtacatgctcctttttctttcactttagtttccacgggctcccttgctcagcagtatgcgcaccctaacgctaccctgcacccacatactccacaccctcagccttcagctacccccactggacagcagcaaagccaacatggtggaagtcatcctgcacccagtcctgttcaggtaagggcaactcagaggtctgcatggagtggcttctttatcctagtatctgagtgctttcttcaggtgccaggtatcgcatcgtcagaacacatggcatgtccaccctcgtga

SEQ ID NO: 625 - DNA, 599 bp, Homo sapiens
tgccctcaggacattgctccagggcagtagcatggtgaggttagcctgatgatggccttgagctaaagagtgtgcacctaaaatgcacttgtttgagtagtttctgcctatgccttcaagttgcctttttgggaaaacctagtgaccgttaagagtaaatgcaaactaatttgattttaatatcatatgtagagctgtattatatgaaccaaatgctagtctgttaagcaatagctacacttattttttcaagacaatggatggtttaaatggagtcatctatagaaattggtagtggcrtgagttatgcattgtaaccatcaagaaagttcagttgatgaagtgtagaggagcgatggaggttgtcagacatcggttgtgtacatgctcctttttctttcactttagtttccacgggctcccttgctcagcagtatgcgcaccctaacgctaccctgcacccacatactccacaccctcagccttcagctacccccactggacagcagcaaagccaacatggtggaagtcatcctgcacccagtcctgttcaggtaagggcaactcagaggtctgcatggagtggcttctttatccta

SEQ ID NO: 626 - DNA, 599 bp, Homo sapiens
gcaggcggatcacgaggtcaggagatcaagaccatcctggctaacacagtgaaaccccatctctactaaacaaaatacaaaaaattagccgggcatggtggcgggcgcctgtagtcctagctactcgggaggctgaggtaggagaatggcgtgaacgcaggaggcggagcgtgcagtgagctgagatcacgccactgcactccagcctgggcgacagggagagactccatctcaaaaaaagagacatcaaagagataaggtttttgacaaaagccctttctaagatagctagaaagaggwcaaggtcaatacttttttagaataaaataattatcctattttatcatttaactgttcagtaatgttagcatatgtgtattaaacatactaaaaatttaaaaacaataatcaggatttcattttgcagtcattagtggtcctatgttttcaatgcctttggctatggctataacaattaatgaatgagaaaaggtgacataaaattgtcaccaacatctgggtgcatgttcttctgtttgcattaaatgttttaaaaacctagatatgatgtagcttaaaaagaaaagcacaattcatac

SEQ ID NO: 627 - DNA, 599 bp, Homo sapiens
tattagccagctgcggtgctgtgcatctatggtcccagctactcaggaggctgaggtgggaggaacttttcagccagggaggcagatgccgcggtaagccgtaactgcaccactgcactccagcctcggcgaagaagtgagaccctgtctcaaaaaaggggagggtaggggacaggaggggaagaaaagaaaccaagcccttgactctgcctgttatttgaaaaatgctaaaaatatttttatccaatacctcaaaggattggaatttagtaaaggagcagggtaaaaactaacatataracagcaatagccttcatatatggtacttcataagtaattacttagaagatgcaatggaagagaagtccctgggttacactaacattaaaaaagaacctacctaaggcatacactgaaaaaaatgtacaaaaccttaaagataaactttatttttatttatttattttctttgagacagagtgtcgctcggttgcccaagctggagtgcagtggtgcaatcttgactcactgcactctctgcctcctgggttcaagcgattctcctacctcagcctccagagtagctgggactacaggtg

SEQ ID NO: 628 - DNA, 599 bp, Homo sapiens
gtggcgcgcacctttagtcccagctacttgggaggttgaggtgggaggaccacctaagcccaattggtagagactgcactgagctgaaatcatgccactgcactccagcttgggtgacagagttagacactgtctcaaaaaacaaacaaacaaaaaaacctatgacttggctgggtgtgatggctcatccagcacctcctaaagtgctggcctgtaatcctagcactttaggaggctgaggtagaaagataacttaagccctggaatttaggactagcctgggcaagatagaaagatggygagactctgtctcaaaaaaaaacaaaaaacaaacaaaaaaacaaagaagaagaaagacaagacaagaaaagaaaagctggcaaggtggcatgtgcctgtagtcacagttacttgagaggctgaggagggaggatcctttgagaccaggaattcgcagcagcagtgagctatgattgcactactgcactccaagcctgggcaacaaagccagaccccatctcaaaaacaaaaaacaaaaccaaaaccaacttaaagatacacactaaaatgttggtggataaactgatgcaatgtctaga

SEQ ID NO: 629 - DNA, 599 bp, Homo sapiens
gtgatccgcctgccttggcctcccaaagtgctgggattacaggcgtgagccaccgtgcccggcccccattggtgctattgttttatgtgatagagccagcttctcccttttctttggatttttaaacatactcttccttttacttagactattctccatcccaacacctttcctaaacttctttcacaccttagactagctgacactttactgagaaacctttcttttttataggttgctttttctatagactctcttagcatttactcattttattgtgaagtgtctgatcttatttaratgacaagtataagaggatagaaactatttcatatttttctcacccagcaggcacaatttctgacatgtggtaagcactcagtaaatattgaactttagaggctaggacatttgagtgctttggtgactgtggttgtgctatataggtactctgttattgttagtttatagtaaaagcattactcttaaagtatgaaaaaagccttattcagaacatttcatgcgtatagttaatattacgtagcttgtgctcatggcaaaaatgtattactaaagttatttaagatatttaagtataa

SEQ ID NO: 630 - DNA, 599 bp, Homo sapiens
aggtccatttacctctaaaacccacattattaacccaaaacagatcaaattactagcaattcttacacaaataaagctatcagcactctgcatatggctcaaaagggaaggaacaacaaacacacaaggtatttctatttctgcctaaatgaaggactacagatatttgtgaacaaatgcagtttggggctatgagcatgtcatgaagttagctctaatgaatcactgactgacagtgcagcatgcactatgcattagttactattcaaagcactgctagaagcttaaacaccagatggycagccctcttacttactagccatgtgagtttgggcagattacttaacttctctttgcccaagctgcctaatatacacagtgcagatacaaacagaacttgcttgacagagatgttagacaagatttaacatacaagcatgaagaacagcatctggtacacaggaaatacgcaataaaacataagagaataacattatattatctgaagagaacaattagaaagttcactcttttatttttttttaattaaaatttaagttctgggacacatattttttttttccactctcttttttttt

SEQ ID NO: 631 - DNA, 599 bp, Homo sapiens
acagtagactgatttagaaagagtagtcactagtggcatggcagaatcaataatgtagaattttgacaattcatatagtgctgatttctcccccaaatgtcagttattttggtcatctattaatagactaatacaagtcatccctttaatagaattttcagctcacagcctgctaagcctaagaaactgcttacaggttactgcttactgttttaagccgagttttaaaattgatgatcatgatagaagagataaataaactaaaattttagagaaatttaagaagggtatgtacatatrttttagtggtatcggggtgtatagggattaatagtcttctgtttaaattttttttttctaattttagaagtaatgtagaaaattcgggtcagggaaaggtaaaatatatggaaagttaaaaatattttatcatgtagtcataatttctagtaacatatttctttacaaataagacatagttgaaacagattgctacagttcttttaagagttgacatcttattgttgatttcttaccaccaacttcatccctccctttctttaaaaataaagggaaataataaaatttatttataaaac

SEQ ID NO: 632 - DNA, 599 bp, Homo sapiens
tacccagctacttgggaggctgaggcaggagaatcacttgaacctgggaggcagaggttgcagtgagttgagatcgtaccactgcactccagcctgggcgacagagacagactctgtcttataaaaataaaaataaaataataattctattggcaacatatattaatttgaagttctaaagagtttggcagccgggtgagagagtgaggagatttggctttgacattagggaagttttcgcttggtgttaacaccagtaggcttctctgatgagggccattctgtccactcttttacctratagattggtctaatgcacagtagactgatttagaaagagtagtcactagtggcatggcagaatcaataatgtagaattttgacaattcatatagtgctgatttctcccccaaatgtcagttattttggtcatctattaatagactaatacaagtcatccctttaatagaattttcagctcacagcctgctaagcctaagaaactgcttacaggttactgcttactgttttaagccgagttttaaaattgatgatcatgatagaagagataaataaactaaaattttagagaaatttaa

SEQ ID NO: 633 - DNA, 599 bp, Homo sapiens
cagcaggtttgttgtataactagagactttctcccaagcaatatataaagaaaaatgtttgtcattttacttgtaggggttaagcaggagtactgtctgttcttgtggatgctcatgaattacttctttgtgattaaaataaataataagaagtagcttaaattaaaattagaaaccatgggaaatgccggtgtgttttgctttaacacccagccaaataaggtagcctaaggaaagtggtgtcttaattgttgacttcacctagagaagaggttgaagtaggacattttaagcctcttrtctgaagaaaaggttgtcattaagataaataattaggttacattggaattaaagcattacataaatttcttggtcttaaatttggattattctccacaaaattcttttatttctaaaacgcctcttgtcacatactagttttgtttctctctttaatgcattatctgtacttgaagtgcttagctgggtatgctggcacatgcctgcagtcccagctacttgggaggctgaagcaggaggatcacttgagcccaggagttggagtccagcctgaatgacataaggagaccccttctcta

SEQ ID NO: 634 - DNA, 599 bp, Homo sapiens
aaatgctttatttacttaaatgtgtgcttttcaaaaactagtatgattaagacattaacaggatcttagacgtaaaggaacagtcctgttgcttcttccagaagataatatgactcgtttggaattttcctatagtgtagttttttgtctagtgttgtgagaattaaagggatttcaggatcttaaggtaggttattatttgatgttttcttggaacattttacattcttgaaaatacacatggctaaattaatttttgccagcaatccacataactttaagataatgtagagaagaacktgattcaggttagtatcaaataaggtcagatttctagtgccatcagtagctttcagcaaagatgaggtgttggtaagatagcattagtctcttagaatctcttagagagattttccaaaattcagccatttctagtgaatgctccattccacccccagctgagtcctgctgctctggggaactccctcagcacactcttggctcttagaattgctagcaatgggagtagtgctgctggtggagctggcagctaagcccagaggtggattaatgcttttattccctgatgtacaggtaca

SEQ ID NO: 635 - DNA, 599 bp, Homo sapiens
tttttgataactgcatttcattgttacttgttctcatttgatttcctgtgtattttacgaatttaagtacattctgaatacggtttcataggcttccctaaaatattgaaggggcccatggattaagaaaaaggctaagaatccctaatctagaggctccccacagtcctcttttgtcatcatacccctaccccattctagcctgaggagcgtggctccacctgtgcccttggttttgttgttccagtccatacatcctgcacccttaactgtgtttcttatccccaacttgtttctttrtgttattcttcagtattatagtctttaatataatctgtataatacatggtgtagtagtatatgctcgtagtatacaattcagttagaacagatgagtattcaatgaaaagataatctcctctctaacccccagtcccacttccctggggaagcctgtgttcttgtgtacaattcagaaaatgtttatacacatattttttatttatttattttttgagacggagtctcgctctcgccaggttggagtgcagtggcgcaatcttggctcactacaacctccgcctccctagtagttcaag

SEQ ID NO: 636 - DNA, 599 bp, Homo sapiens
gcgtgtggacataggttttcaattctcatgggggtgtgtgtgtatgcatactcatacatacatacacatacctgcaagataattgctggctcgtatgctaaatctatgttgaaccttttacataactgttgggctgttttgttttctttttattattttttgaaaatagagttggggtctcactgttgcacaggctgatttcctgggcatagtggctgtatcattttacaatcctacatagctgtttccaacgtagctgtatcattttacaatcctactagcagtgtctgaggtttcttmtgtttttcacatcctcaccagcatttgttattgtctgtctctttgattatacccatcctagtgggagagtaagaagtagtatctcactgtagattttttttttctgtttacaactttactttaaaaattatatatgcacacatggtaaaaagttcaaaacgtgtgtaccaaaagatttaacagtgaaaatagaaaataagtgtggtccttgttttcttccaccaaggcaaatattgttataatctcctaaacaacttgtcttccagatttctcattttcagtcaatcttgggcattgac

SEQ ID NO: 637 - DNA, 599 bp, Homo sapiens
cccaagcaatcctctttgcctcagcctcccaaagtgctcggattacaggcttaagctatcacaccaggcctaggctaatttcatattttgagatggcacaaatttctttcaggtagctagcttttcctcctcctccccacttaaaatagatcctgatccagaagcctaatggagaaaatgaaaacagaatgttcacccataaacagtatctttgtattggaatcttttctaaaacttcttttgatctttttaggagatagtgtgggaatcagcaatctagtattacgtacgtggaatctrtcaccttgtttttttaaatacagcaaacctcatgaagtgaatttccatattttttcttgttcttgttagttttgcaccactcaggctttgctgtagaatttgatgtatatttgattctgtagagcatgggctattgatcttcactcagctttcagaggaatctgattagtaagtttgagttttttattattttttagttgattttgaagtaaaatacagcaccattttaactgataccatttctaaacaattttcagttcaaattttaagttagctaatttagagcttaagaaaattgc

SEQ ID NO: 638 - DNA, 599 bp, Homo sapiens
attttcactattcaaatctataccaaaagctgtttttattgttgggctgattcttctacactgttacttggaaataataatataccaggattctttctcttagacttaggagtctttctctttgcttgctttttcagaggctaacagtactgggtattctttaactgtcttgatatgctgatgaaagcacagtgttctgtttttgaatcttctcaaatgtccttgtctttgattcacaactttttgtcttaagaggccttcagcatcccatacaaggaaacaagtctttttttagctgcyacctttggagttgattttgtttatgtctaggagcactaaattatttatacttatactattgaaatattcctctgttataaattcaaaaattgactttggaagataaaattttagttgaatttaatacatagcactctggaaagagtattggccacaacaaaaaaaaaggttccctactctattggataccaggtcatttaacagccatttacggtatgcattgtctttttgtttttatgatgaattgatatttcccaaatgtggaagagtgaatattactttgagatgtttgtgatagt

SEQ ID NO: 639 - DNA, 599 bp, Homo sapiens
gcattttctacagttttgtggtcaagaatgctactgattatattcaactgaaaatttcttgtcccatttggcctacaatgctttagtttataagtgggcatgtggcaaatctggaaagaaatcaaagtataaggctaaggaagaaaggtagagaacggttggtagaaaacaattgtctaatgaaaatgaaaaagggtgaagaagtagaacatacgtattttaaaaatattcagagtatgagacaaggttttgagaatttaaaagcgattatgtagttatattaaaaatttagtctctttytaagtgtccattgatgaacaaagtgggaattcctgttactcatttgcaaggcattattgagtgttcagtaacacgttgcaaggcacttctgggcaatcctgaacttggttctcaaattctttttttttttttttttgagacggagtcttgttctgtcccctgggtggagtgcagtggcacgatctcggctcactgcagcctctgcctcccaggttcaagcgattctcctgcctcagcctcctgagtagctgggactacaggcgtgtgccaccacaccaagctaatttttgtattttttg

SEQ ID NO: 640 - DNA, 599 bp, Homo sapiens
tatttagagacagagtcttgctttgtcgcccaggctagactgcagtggaatgatcgtagcctactgcagcctcagactcctggactctggtgatcctgcctcagcctcctgagtagctaggactagaggtgcatgccacatgcctggctataattattattaatttacgtttagcattagtttttttcttccagtaggctattttactttatttatttgattttgatgaagtttgattatttctagtttgcttccttctatgacccctacctgttgtgggtctccaggcaagcagtgcayaggtagagccatccttaggtagcctttagacttaatattaggtgagctctccccacagatagcctctcctttatttgaatggaattatattttaagtttggaaatatttttcagcttatttagcctgttgaatttaataaaaataatatttaatcttttcagaggtcgaaacagtaacaaaggactgcctcagtctacggtgagtaactttaatgttacttattggggaaaattagtagctaaaacatgatctctaaccacagaccaaatgccaaggcaaaagattcccttcttttgaa

SEQ ID NO: 641 - DNA, 599 bp, Homo sapiens
ttttgtatttttagtagagatggggtttcacgatgttggccaggctgggctcgaactcctggcttcaagtgatccacctgccttggcctcccaaagtgctgggattgtaggtgtgagccactatgcctggcctaattggcctaatttcaatattgttatatctcagggaatagagaggcacgaggagaaagagagacaagctgactgctggttcgtggagtagtcataacacacaacatttattaagattgctgtcttatatggaccgtttgtggtgccttaaaagaaatcagggtaacrtcaacgattactgattacagattactataacagatacaataataattgtaaattattatttacaattgtaaaatacaatcttttctttattatttacaattattgtaaaatacaatctgattacagattactataacgtatacaataatagtggaaaagtttgaaaatattgtgagatttatgagaatgtgacacaggcgcaaagagagcacatgttactggaaatacggcactaatggacttgcccgactcggggtttccacagacggtcagcttgtcaaaaatgcagcatctgtgaa

SEQ ID NO: 642 - DNA, 599 bp, Homo sapiens
gattacaggcgcccaccaccacgtctggctaatttttgtatttttagtagagatggggtttcacgatgttggccaggctgggctcgaactcctggcttcaagtgatccacctgccttggcctcccaaagtgctgggattgtaggtgtgagccactatgcctggcctaattggcctaatttcaatattgttatatctcagggaatagagaggcacgaggagaaagagagacaagctgactgctggttcgtggagtagtcataacacacaacatttattaagattgctgtcttatatggacmgtttgtggtgccttaaaagaaatcagggtaacatcaacgattactgattacagattactataacagatacaataataattgtaaattattatttacaattgtaaaatacaatcttttctttattatttacaattattgtaaaatacaatctgattacagattactataacgtatacaataatagtggaaaagtttgaaaatattgtgagatttatgagaatgtgacacaggcgcaaagagagcacatgttactggaaatacggcactaatggacttgcccgactcggggtttccacaga

SEQ ID NO: 643 - DNA, 599 bp, Homo sapiens
agggataagtttatgagcaacgggtagatcgttgggagagacttgagtttcctgtcaggaagcattcttggtgcataagtcagaggtgatatgaatgccgtggaagggggtggcttactgtctggagaactcgagaagatgggaatgggcactgtccagtattgtggctacttccacacatggttctttaaatttaaaattatgttgattaaaatttaaatatttcagttcctcagccatactaatcgtatttcaagtgcttagctgccacatgtgcctaatggctgcaatattggacarcatgacataggacatcttcatcattgtacaaagttctcttggacagcatgggactagagccctaagatccttttctacctgagttgtttggattttttggtgtgtctaggttggatctagttgttcatggcttcatgaccaagccttttatccctttctctagagggactcaaggggtaaaggcactgaaggggtaaaacttcatatgaagagtgtggtggtggtggtggtgttttaagacagggtctcgctctgtcactcaggctggagtccagtggcatgatcctggctcactgcag

SEQ ID NO: 644 - DNA, 599 bp, Homo sapiens
aacatctgggccctgattgtgcgcatcattacgaccattctgctcagcatcatcccagtgttgatctttcaagtctatcaacagatcaggaggcattatctaggccaggagctctgcccgtgatctgattcccatgtactccatccaccctccattcctcgccctgcccccagagccaagttctctatcagccgtttatcctcacacacttttctacaatggcattcaataaactgcacgtgtttctggtttaaaaaaaaaaaaaaaacaccagagccattccaactccaaatgcgtttkactctacattgttgaacatctactatgtgccaagaacagaacataagaagaatttaggctgggtgtgctgcctcatggccttaatttcaatactttgggaggccaaggcaagaggagtacttgagggcagaagttcaaaaccagcccgggtaacagtgagactgtctctacaaaaatttttttaaattgtagggcgcagacactttgggaggcgaaggcgggcagatcacttgagctcaggagtttgagaccaacctgggcaacatggtaagaccctgtcactactaaaaatacaaaaa

SEQ ID NO: 645 - DNA, 599 bp, Homo sapiens
ctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcstccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcg

SEQ ID NO: 646 - DNA, 599 bp, Homo sapiens
ctggaggtggaggttgcagttagccaagatcgtgccactgtgctccagtctggacaatagagctagagaccccttctcaaaaaaaaaaaaaaaaaaaagggaaggctggcagagggtggatgttcaggaccctggactcacacaaaagtggcctcaactcagtactctcctttcccaaaacaacaaaatcgaactaggagctgtgtcttttacattcccaagtcccaaagttaggggagatagtagagcagagtggtgataagcccaggttttggggttagatgatgtcaagattgagarttgactgagtgtggtggactgcaactgtcatcccagtgctttgggaggcggaggtgggaggatcacttggaattcaaggtcagcctgggcaacatagcaagatcccatgtctacaagaacaaacaaattagctgggcatggtggtgtacctgtagtcccagctactcaggaggctgaggcaggaggatcacttgagcccaggagtttgagactgcagtgagctatgatcgcgtcactgcactccagcctgggcgacagagaccttgtttattaaaaaaaaaaaaaagaaaagaaaagaa

SEQ ID NO: 647 - DNA, 599 bp, Homo sapiens
tggttgttatccgattggagctcgcggaacactcgcctgtccccgccggcttcggcttcagcgccgcgggtgagtcccgcggcctcgccgcattccctgtagccgggtctgggcccggagggcttcccttcccaaagcactggcccgggaaaagcccgcggcgagggctgttgcccaggaagacacggagaggtaatcgggatccctctctttcccatccgcctttgagaggccttcccgtttgttatctcagggaagccctgccccgaacctccctccctgtgccgtctgagggcattyagtttatacctggcgcgtctccctctcgagatagtcgagtggtgtgtttgtctcacttgcttccctatgggcttcgtaaaggcagggactgggtccccagcaacgctggacggtccctgggttaattaaattgttcccttttggaacgatatccattgaagtgccccctaaccatagtcataactaaaatttggacacttcctatatcccagcactgtactaagcaccttttgtgtattgtattctttaattatctttgcaacagccctaagaggcagatggatgtgacatgtacctct

SEQ ID NO: 648 - DNA, 599 bp, Homo sapiens
atttaagggacaattgaatagaattttaaaatcagagaggaggagccatgtttgtattgttcacttttgcattcctggcacctagcaccttagcataggatcactgttgggtaaatatttattgaataatgaatggttgccatttacgaaaccatgtttacagttttgtgctccagaagtgaggtaaagggttgcttaatgagaacccagtatttctactcaaaaggaccttattgcaaagtatttggaagtttaaaagagtgggaacatggggacgcatagggagtggtgaaactggcycagggaaagtccattgcagcaagatagaggttgccaaaccgtaagcagaacaagttgaaaccgcgcctgtctggcaaacagtccaaagtggaattgaaactcccatctttgaagtggtgaaaaaaggccctggggtgggggagtggggcagagggctggcgtctgtctgcctgggttagtcttggttcgggagtgtcccgagcaagcctggggagatgactgcccctcgccttgatccccaactaacctggggttctggattatgtgtggggaagagggaatgtgtgtggcattccgtg

SEQ ID NO: 649 - DNA, 599 bp, Homo sapiens
caaccatcaccactaattctataatattgtcattgcctcccctaaatatcctgtacccattagcagtcactccccattcctccccctaccaggcccaggcaaccaccaatctatgttctgcctatagatttatctattttggacattttatgcaaatggaatcctacatggttctttgtgtctggcttcttccaagtagccatgttttaaaggttcatccatgttgtaataagaatgtatcagaacataaaaggccaagtaatattccattgtgtgaatagaccacattttgatttttcyattaatctgttgacagacttgattgtttccaccttttggttactgtgaatagtgcagctaggggcactaacatttctttctttcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgac

SEQ ID NO: 650 - DNA, 599 bp, Homo sapiens
atttctaggctgtctggtcttggaccacctactctcccaagcctgagattctttaagctagcattagcaacacctgtttttcagcatgactgtgtgggttggaagtgatatatgtatagcacctggtaacctgctcacttagtgccaataattattccgggaggtacttaatgctgtggcacctgttgtattctttgtactgctggagtaaaatacttcctgcagagagagaccagacttactgtggataacatgatttgggatgattttatctgcaaataaaatacagaatccaaacaraatcacatcaacctttaaactcagcggcactgcccccaaactttcagcttcaggattggaatggaagtctgactgagggacagtttcctatgttgccccagaatattctcccgtggctcccaccttatatactccacagcctcccgagtgcaaagcacagtccctggcctatggcatgcacccagtatgccacatggatgtgcaaagaaggaatggaatttctcttttcaaatatctacgtgaccaggcacctgctctgcttttctttcagatcttcccagacccgtcagattttgacc

SEQ ID NO: 651 - DNA, 599 bp, Homo sapiens
tccatatacttatgcatatattggtgcctgtgcatagatattaatattattgatatgtgtatagatggataggcagtattttacacctctattagcaacaaaaagtacccattttgcattctcttatcatcaagaatattatattttaagaagatcaaagtattacagatcaatttataggcctaaatttctatcactttttagtttacttagctgttccattagtcactactaaagagcccacgcctcgccccaccccttacgttggcattttacatttttttttagcagaaacattcrtattattttcttaactgatatttttggaggggtgttagttaatatctcagtgatttaagaatattcttaatattgtgatgtttatacttgagttgtcacacatatttggcatgattatttgtttttcctctgatagagtcagctttcctctattctgggttacagtacccctattttttcccatcaccatccagctacatgtaagttgtagcatgtagctgagacttaacttcatcggtataaccattctgaggccataatgataacgctgttgattagtaagtgccataaaaagaacc

SEQ ID NO: 652 - DNA, 599 bp, Homo sapiens
tttattttgtatgtaactatccagatttccaaccgtttattgaaaaggctgtctttccttcattgtgtgtttttggcaactttgtcaaaaatcagttttaactgcctaaatttatttctgtgttctcatttctgtgccatttgtccatgtgtctatttttatggtagtacaattttattttggttattatagcttgtcgtttattctgaagtcaggtagtgtgatgtctccagctttgttattttgctcaaggttgctttggctatttgagctattgttgctctatacgaaatttgtgayagtttttctgtttctatgaagtatgtcatttgtattttgatagggattacactgaatatgtaggacactttggttaggatggacattttaccaatattcattcttccaatatattatcacaaaatatccttccatttaattgtctcttatttattttctttcaccagtgttttctagttttcagagtagaagtttttcacctccttggtgaaattttgttctaagtattttatttttggaaggtattgtaagtgtgatagttttctttatttctttttttcacatagtttgctattact

SEQ ID NO: 653 - DNA, 599 bp, Homo sapiens
gtgttagctaggacggtctcgatctcctgacctcatgatccgcctgcttaggcctcccaaagtgctgggattacaggtgtgagccaccgcgcccagccccaaccaggtccagtcttaggaatagttgttaacatcacttttgatatcagcatttactagatctacaagttagactcagtatgtccctgcttttcaaataactataaacaacaaccctaagggaagaatgccttggatgagtgtaattatttgagcgtaagcaaaatgactttatttaaaacagtaagagcctggtgacartaactccataatagaaaagaaacgtgaaccgcagcaccccgagcgtgaccgaaaacaagtgtaacaactcgcatcgcctgacctcagcgtggggacccagagaaaagcactgtcttccctcccactgggttgcttcccagactttccttgaagcacccagggtgttctgttcttgaaaaaaagatggggttggcacttccttcgctaccctggtacaaagttcacagagatgctaatctgatccaccctggaacatttcctccctcaataaaattctctctccaaagacaaagcaaaca

SEQ ID NO: 654 - DNA, 599 bp, Homo sapiens
ataaatacctggttcctgctgtgccctcaataaatatttgtttaattagccctttcagtaaaataaattcaaagaacccagttgtttaaactcacttacaggaaactttttccgtatgctccaagtacctggagttttgttcactgtggattctgatcttgaaatccgattactcaaagcctgccatatgtccttcagtaatttgcaacacaacagttacatggttctgttacagtaccctactaatctcatcctggactgggcagaagacactgtgtcagtaattaaatttatatcacrgactaaacagagtttctttttgtttttactttgttctggttttagaaagaagcacacagtgcagacatttcagcaggtactaaaagtgtactctcagacactgtcttctcttctgtagggtcattcatatgggaatttaaccattaattctaaaaagcagagaaagtaggagagtagggcaagctagaggtaaggaaggcaaacacccagaacaggggtgccaccccacggaaataaggaagtgcagttggccccatggtccctggtctgacttccccataaagtgacaatacatagag

SEQ ID NO: 655 - DNA, 599 bp, Homo sapiens
tctgtttgcctaacagctgaggccttttttatctagcctcgtacatgcaaactgcaccatgtaagatgttatatcccaagcttcttcctcgaaaaaaattgcctaaatagagaaacatgcctacggaagtcaagagctttctgcaatttgcatttgtgctgtattaattgtggctgaggcccacctcagccataggcaaaaaagctgccatccgtaagatccattttcatgcatttaaagaacaaactactcaggaatgattcccttacctgagtgagtttggtacttacagaccccagyttccagaatggaggttgattccttctgcttgaggcattagggattaaaagcagttggctctgagaaggcttatttagtaaaccttagaaatcttttacacctgagtgtttttacttcccccatgaggtctccaaagcatttttcaactgagaaaagggcaggagagtatctgaccaggcagagcaaactcgctcctgtacctaaaacacctgctctgaccacaactgcaactcacaagttagagcatgctccaggtgcagaggacagtgcgaggatgtgatttaagcattagatccagc

SEQ ID NO: 656 - DNA, 599 bp, Homo sapiens
aggtgagtttactttaataagtcaactaataggtcgtcagaagacctgtagcttgtaggaatactgaaaagggattgggggtacacatggagcccaagccctagaatgagagccatcccgacaagccacaaactgtagggcagtcgcaacaataccacaaggataaacttagggcaaaattcagaaaagaaattgtggtaacagacttgggacattgttcaggagtcaggacctagtggttgagaacgtttaaaaggtggcttccttgatgagattggagggaaagtccaagtcaactgraacatcattctttatcattcttgtgctgtaatccgtttctaaaactgccctggctattcatcggatagcttacatctaacccttttctacctttttgactttaacctatttatggagattgtgatatgtagcttgcatccttcccaggactatttgaagagtgataagagataatgcaggtgacagcactttgccagctgaaaagcactagacaaaggtgaggctccagcatcacataacctgcaaccctacttgctgaggccaggagaggtctgggccaggagatgctctgtccccag

SEQ ID NO: 657 - DNA, 599 bp, Homo sapiens
aagatctgagtccaaatgggctggcctcaggtgatgggagcttgaaaatattcagaagtgatgatgccattaaataatgcttatttcctaaattgcagtagcattggaatgtgtctactctatgtgccaagagctatctacttttgcataatttttaacatttgcatatcatcaaaaacttttcatagtgcctgttaggtataagatactctatgagttactggactggggatggtagcagaagctggggaaggatttagagaaaactttctcactctcaagaggtttgaaaagtaactkgaaagacagagcaggtaaagaggggacaatattagccagatgtggtggtgtgcacctgtaatcgcagctacccaggaggctgaggcaggagaatcgctggaacccaggaggcagaggctgcaatgagccaagatcgcaccactgcactccagcctgggctacagagcaagactctgtctcaaaaaaaaaaaaaaaaaaaaaaagtaaacaatacaaggtacactggtggaatagacaagggtcatgggaagacagaggcaaagatgagagctacagagtggttagtagaagaaaatttt

SEQ ID NO: 658 - DNA, 599 bp, Homo sapiens
agtccgggagttcaagaccagtctgggcaacatggcgaaagcccattgctacaaaaaatatggaaaattagctgggtgtggtggtgcatgcctgtaatcccagctactcgggaggctgaggcaggaagatctcttgagcccaggaagtggaggttgcagtgagctgagatcatgccattgctctccagcctgggccacagaagaaaatcctgtctaaaaaaaaaaaaaaaaaaagaaaaagaaagagaaaaagagaaaaaagaaggaagcaaccagcaaccaggcaaactaagatttagyatgttattgaatcagctaattcttagtttggctttatagattggctagattattcacaaggcaatgttaagcataaaaaatccaaaagggactgctttgggtgaaaacagacaaaggaaacataaccaaaagtaatatatgatacttgattagatcctaataaagcagcctataaaatacattcttgaggcaaatggagaaatttgaatatagtccttatagtagattatatcatagaattattattaatattcttagttatgataatgtggttagtagaagaatattattattcctgg

SEQ ID NO: 659 - DNA, 599 bp, Homo sapiens
aaaagtgaatggagtagaatttattaagcaaaaaggtaagctctcagagaaaagacgggtcctaaaagcaggttgttggttgcccccttcacagttgaacacaagggcttttatatatccgctgatggggctgggttccctaggtgtataaagcgccaattcctggcggctccaccctgttcttccagttgtgcatgccggccctttgtctgagccactccacattgatttatatcccttactgcgcacgtgttgagggacggaatttttcaccaacggcatgtttaaggaagcccctgrgcacaacgtccttggcgggtgggagcatctgcagagaccctcccatatctgcctaggagagttctctggcacctgcctctatcgatactgttcagatattatttggaaatatctggttaatggctttgtagcatctcattgtatgaactagatgtatacacttttaaggtgagtcaggcgcggaggaaggcaaactacttgcagcacacttctgagcttgcatttctctacctagactcaccatattctaacaagagttactccagacatctcctgaacaatatcaccagcacttctac

SEQ ID NO: 660 - DNA, 599 bp, Homo sapiens
aagtgtttctgtatttaataacacagaaaaaactcttgactgattcattaattcagtatttttcagtacttctaacatcaacctccatgtgacatttctttgggcatgctgaaccatttaaagctttgcttcctctgatgtctagaggttcctccttttgataggtgtgtaagtgatggcatcttcctttacaactctggctaccaggaagctcaggcaaatttgaaatttaactacatcaatgatgcagcttttaccagccacatatatatatattttttactgtttttaaattgaacmgttgaaatataattttgtcttcgcctgtttaggatgccgtaacaaaatcctataggctgggtggtttaaacaaccaaaatttattttccacagttgtggagggtagaagtccaagatcaaagtgccagcagggttggtgtctggtgagggttctcccattgggttgcagatggctgccttctccctaagtcctcacatggtctttcctctgcgcaagtgctcagaaagagggaaagcaagaaagagagagtgagccatagagagctcactctctggtgtctcttcttgtaagaacacta

SEQ ID NO: 661 - DNA, 599 bp, Homo sapiens
gatgataaacttgcaaaataaagcaaactaatatttaatgaacgcttgctatttgctaagcagtttacatatattattgcatttaattcttataaacagccctttaaggtggattttatcttagaatttaatcatgattgtgttcctaaggcctagtgcaatgcctggtacatagtgggcacttaacaaatattgaattaagttaaattccataaaatcaagaatgcatagctgatctcaagaggaaacatctgcaaatgcttacctccacagaatcaaatatcactgctggtacagctrtgttgttcatttttgcagctttttggatgatatcttcagcctctctaaatcttctctgggatatcagccatcggggagattcaggaatgaacctataatttatttttaatatttaataatttttcacaacagcagggctggatactattaaatctgagtttcccccaaatagttttaattttgtaaaattctagtttgtctttttaaagggagtccacataagatttctattggagcataggaataaataaaaccaccttcaagtttcaaacttctgatcaaattataagaccgatcat

SEQ ID NO: 662 - DNA, 599 bp, Homo sapiens
gaggataccagttgacaggaaagaatgaaaagccttatgataatgcaaaaggattatagacatgcacaatgtcatctgccaaaaagaaactgatattttgcttacttttttttctctgaaaatgttcagatttaaatccattctcttatactgttcaccaacttcacaaaatgatgctcaagagtgcccagagagtcctcctatctgattgatgttcttatgtcccgggctttacaggtgcttacaacagaatgctgccctacatcgtcatgggtagtctgactgtcctgattggaatcytcaccctttttttccctgaaagtttgggaatgactcttccagaaaccttagagcagatgcagaaagtgaaatggtaagtaggacttttaacaaaatgataccaaaatgccttagggagaataagcatggaagaatagctaggaaggttctgaaatagaagagtaataagtagagactagctctatcagataataaagcatattgttggctgggcacagtggctcacgcctgtaatcccagcactttgggaggctgaggcaggtggatcacctgaggtcaggaatttgagaccagcctgg

SEQ ID NO: 663 - DNA, 599 bp, Homo sapiens
tgcggctgtaagagtgtctcaacgagcccagtggggagttccagccaaagattgcccaggagaagagtcgcactttgggcagaaatggacaggcccgagcaaccctgccatgttctgtcattggctgggggccacccaggaggcaacatggtctgacttgaatggtgtggatccgaggctgcagcctgtcagctgtctgcactccatgcaacaggtcctttgaatggcatgtgttcgtggctgccataaactgcagcctgccttttagccttacctcctttgctcttgctctctgacccygtgttctggcaacactggcctgactacacgccgtatcacatacaaccaactgcccataccaaccccaaccctgacctttgctcactcagttctttctgcctggaatgccactccttcccagttatacccagcaaaatcctaatgtgctttcaaggcccaacttaaaaatcatcttctctggttgacctcaccatgtagaattaattgttccttgctcctatggtgctatgtgtatattagtacttcccagattggagtattcttagctgtttttttctcagatttttgcctcctctaaa

SEQ ID NO: 664 - DNA, 599 bp, Homo sapiens
aagtggtctatgaaggaaggaaagtttgggtccaggtcatgatctctgcaatgagctgtcttggtgtccttaggcaagttacttaacctctctgagctttcacttcctcattagaaaaatggagatgatattaaccccaaagcatggactgattaaaattttacatgagatgtattgttctattttgctaggaaataggatctcagtaagcatctcccacagttgcctgcccagtattttatcctgtgaactaataagaaaggtgccttataagtaaagtgactgtataatttattgtcraaaccaaaacacctttgtgaccgaagaagtccactcttaataatcacgccaaaacaacacacagaaactggaatcgtcccaggagaacaagtcactctacttacagagacagttagggaaatttctggtccaggaaaatcagtgggctttgctgacaaggatgtccagaagcttctaagagtagatttgaatgaaacctgaagttcacaggctaagaaaaacagacaggcttctttagacgtaaatgggctgacaaagagaacaatttagtttggccctgggaaataattgagttagta

SEQ ID NO: 665 - DNA, 599 bp, Homo sapiens
catcctcaggctgtcagggtgacttcagatgagcctggagctgagctcagttccggaccccaggtcctggctctgtcaatgccggactggtccaatctctatgccaggtccttccaaccccatccctctctttatcaaagtaggaatcaagaagatccgaaggctcaggctctcaggttgttagagagtactgaaattggaggctgtggatggctgggccctgccgtgctcccggtccagctctgactctggtatggccccagctccttcctgtaaaatgaggggataaaaatcttcagyagccctgtgtaaacttctgcaggctctgttaacaggtctaggaggacaaattgcagggctggtgtcagtcactctagactctggatccccagggcacatgtcctccactcagcagaggctgcaccttctcctacctgtacctcagtaccagctccctgagcttgaggcagaaatttctgaagactggggtggagcgccatgcggaggggccgtagaggaacagacgagccagaattcaaatgaggacggtgatggcactgcagggccacagcctggtttacctgccactcttccaattg

SEQ ID NO: 666 - DNA, 599 bp, Homo sapiens
gaaaggcagagcttggcactcaaggtatccagggcaagctgtaccctccacaaattctgcattcacttcctgttttgcacattatttatatttctatttgtagaaaaaaatccaagagtctcctgttcactagcagaggagagaaggtatgcaacatccttgcagataccttctctctgctcaggagagttaatgaactggactttgagaactcacttccagccaggtagatgcaggacaggactctgctattgggtgcagtacccacctctgagtctgaatcttaccccaccccatccytccctccatgtacaggtctcttctctccctaactctcccttcagccctgggaattctctctccttggcctcatctcatccctgaggcttatcttataggtaactcactctatctcttattccaagtttattatttacatagcttggaatagaagggagttagagaggaaacaagggtgggagaaaaaaaaagaaaagatagttatgtgaatttaatttaggcattaaggaaatacccctgacaaaaactttactatgccagtggggccacatcaaaatggcctcggcaggggaccctgt

SEQ ID NO: 667 - DNA, 599 bp, Homo sapiens
aggagaattgcttgaacccaggaaacagaggttgcagtgaactgagattgcgccactgcaccccagcctgggtaagagagctagactctgtctcaaaaaaataataagacaaaaaaaaagggcatggatgagaggaccagagggattcccagtaaatgacaaggtgaaataagaatactaaatagtttctgagaatactgatttaatgagacaagaaaataagtcagacactttgaaaattcctactaaatgacttgaaacaagaaataacaatatgtagatgtagtatcatgtatgttrtgttttgtccttcagaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaagggtaaatgccaatgattgttatggactctcttccttacttttacttgacctttttaggaaaacctggaaatataatatgttttatttttcaagaaagcctgtttcctaacattggcctaaatattaaatagagcttctt

SEQ ID NO: 668 - DNA, 599 bp, Homo sapiens
tattctcctcgagggcagggtttatttgatatttttctggagcttagaaccataagcctggtgctggggaggaagcgcccttagcatttggtagcctctgtgggcagagcatggaaagtcacaacttctgaattgtttgtattttcagtctcactctagatggatggcatcttctgctatgggaaatgaaatatgtttaggcaacttgagtcccaggtgcagatgaggctgggctaattggtgcactagggaaggagccgggggagagatgtgctgttagctattatcaatctgtgacarctgtcagctgctggcagttagcacccacctgagcctgggatgcaggggtgcctctcctgtcctctgtggaagcctctggacccagcagccatcttgactgtgcactgttcaagccccaagtccgcctggaagaggtgattgagaacttactgcaggataaggaaagcgcaggacaggtgcagtggctcacgcctgtaatctcagtgctttgggaggctgaggccggaggagggctggagtccttgagtgcgagaccagcctgggcaacatagtgagaccctgtctttacaaaaaggaaa

SEQ ID NO: 669 - DNA, 599 bp, Homo sapiens
agcactcaaaatctgaagggaagtaagtgttatatgggggaagtaccaggagttaggggagcatataacagtgacaactaatccagtctagtgatcaaggaaggcttccctgaggaggtggcattaaagtcaagacctatagacaactgaaaagatgggtaggagtcattctagcagaaccactcttagatagctctataaccccaggataactgcctaatctccctggaactcattttatctttagatgtggataataattagcacaatagacagcactcaataagagttggttctccyttccttcacaggaaggtggccttccaatctaacgcaccatctatgagaaaaagagtaggtatatgtagagtctaataacacaaaccataattgttcttttattcattctgtaatatttcttgagcactggctgtcaagagcttttctagacatggatgtgcagttcctactcatcaattctaatagagaatgtatcggtcaggatggactaggttctgctgtgtaacaaacacaccaaaatcccaccagcttaacacaacaaaagtttactcctccctcatagagtctgctgcaggtct

SEQ ID NO: 670 - DNA, 599 bp, Homo sapiens
agccagggaggtgaactgtaattaaaacgcagatggataaagcaggtactcctttaacatgcaaattgagatcctggcggccagcaagctccattttgagcctgggcggcaggctttcttagagggggctttgttagaaaggcagagggctttgttagaaaggcaccatgaaggagtggaaggaatggggattaaagaaggttaaaggacttggttaaagaggccaacaaaaccctcccaatggctgagttgcaagtttttaaattactattacctacttgagacatattttgaaaggcrtgaagaagaataaatggccccaggagcagattaagaagtaaacatccccagtctatctgaaggctcttgtgtgccccgcctcagcaatacccacctctgcctctgcagagggagcctctattctgaagtaggtgttactccagcctcatgctgtttttatacttttattacctatttggctggtttgtttattttttggagacaaagtctcgctctgtcacccaggctgaagtgcagtggcatgatcacagctcactgcagcctggacctcccaggctcaagcaatcctcctacctcag

SEQ ID NO: 671 - DNA, 599 bp, Homo sapiens
aaccttggcttcacactaaaaccacccaggaccttttaaaaataacaatgcccggttctgcttcaaactaattacatctgaatctctgggagtggagctgacatcagtattttttaaaagcttcccaggtggttctggtggcagccagggttgaaaaagcactttgctttattgttttctccctcaaggtagtaactggatctgcttattgacaactttatccccaacacctagcctagtgcctggcacttagtaggtcctcagtgggtctttttaattaattcttttggcacaggtagrctattcacctgatttttaaaatatcaaaaggtatacagtggaatgtcttcctccttaccttttattcatctagttctcacttctccccagtcacctagtccagggggtcattgttatagtttattccaggataactttatgcaaagataagtaaaattgaatatatatatgtatatacacacacacacacacacacacacacacacacacacacacatacatatgcataccttgttaaatacacacatatgtgtccgtttaagtactgttgagttattggccctaatcctttactctct

SEQ ID NO: 672 - DNA, 599 bp, Homo sapiens
gattttttttgtagtgatggggtctcgctatattgcccaggctggtctctaaatcctgggctcaagcaatcctcctgccttggcttcccaaagtgctgggatcataggcatgagccatcatgctcggtttattcatgtttctaattgtcctcccatcttctagagggaagttaatataactttgatatttgaatttttacttcgtgattcatgtggcatactgagtatgaaaatcatcttcctccctaaaggccatcgttttttctccccatgaacatttatgccaaatactgttttgartttaatatttccacatcccctaagcagaacccagtctgacttctctctctttttttttttccctgcctctgagtctactatgagaaatgattctgactcataaaattgatgtatctatagaacaaatggcagttgtggcccctcctgaagatgactctttgggtttccacactttctggattggacttgaattccttggtgtcattttcagggcctcctgcggctttgccccacatatgcctcagacccatgcaaatcaagtcctggattttctggctatttttactctaacacagaat

SEQ ID NO: 673 - DNA, 599 bp, Homo sapiens
aacaccaaggcatctttgtcagttgcctcagctagagaggtgacgacagggccaaaagccgagagaatgggatgccaagaggtggtgtgatcccagaggccttcaagttagaaggactctctgagaagagatccttgttttccatcactgcagagaatgctataccaagggcgagaggcctctaggtcagagatcataaagaagaaaagaatggctggattttaggggtggtgcccaacgattagtttgtgttgtaatgtggcatgaagcgtcttcagaatgcatttgcgatgtttactrggatttggaaaaggatcgtaacaaggtctagcaaggcagtctagcccaaggagggtccagttgagttccgaactagtttctgatatctatcccttccaaaactgcatgtttaattaaagaacagccctcctctatcttccccagatagaggagggctgttcttcagtcgaagatatggagtggttgtgtttctctaccaaaacctttattccattttctcaaattttagcatacatcagaatcacctggggggcacattaatacacacattatggaccatatactgtatgcctggcatc

SEQ ID NO: 674 - DNA, 599 bp, Homo sapiens
taagacaggactttctgctggtttaccttagttttgtagtatccagtcaaagggcaagagctgtttccctcagttctagttttgtccctgaaggaggaagaaacttcttcctggctggccttggatccaccccttggtctctggcagccacttatcgactgttgtttgttttctggggtctacattgaaagatttcaattgcttattctatctctggcctagagtcctactcagaaggaatttattttgaggcttttctagcttcatttacctaaacatcatattttaaaacaaaaaaamatttgtctccttaaacctgtccactggatttctttcatcctctatagctggagatgacagtgccaggaaatgtgattaccttagctgctttgatgagcctattagatggaagtatggttaaaaaaaatcaacatcataacctaaaaaggccttctattaaagacgggaacctccaccttcaacacacacacatacactgcacatatacacatatacatttgcttttaacccacaaaactcagacactcccctgagggtagagagtaattttgctcttgtataccgtaaatcatgaaaag

SEQ ID NO: 675 - DNA, 599 bp, Homo sapiens
gctcagaggcagtgaagcatcactttctttttatcaccaaagaaacctctttgacctattcttgcaatttttctataagtgcaagacgacattaatttttaaaaaaagaaattaagaatgttatctctttaggccatccctatcccatgcagacacctactttctatttagactgagttattcaggaaggagggaagaggggatggaaggaaggatacaagaacatatttagaatatatttttatggacatattttatgactatttggggtatatataaaaattatgaaaattcagttcrttaggcataaaatggcataaaaatatccattgtgtctaagttgataatgattttactcaaattctccatatctttgtttacttttcttcttcaaatgaccgtttttgaaatagtatgtttaaagcctctgctatgattgcagttttatcaccttcctgtctatttataacaggtttttttctttgcacttagtttgaatgtagcccaacttcttatgacaacaagaatattaatatttttgcagacataattaatgtatcataaggaagtcactatcaaggtcaaagcaagtgcaggta

SEQ ID NO: 676 - DNA, 599 bp, Homo sapiens
actggacaagacgattcatgaggattggaacttcatctattttctttatgctttattcctcagcatgaagttttgcacatattaggcactcaataagtaagtatagaattagcatttattgaatctcaataatataaccccagacatcagatttgtctctattcatcagccacacagatctgatcatgatattcttccacttcacaatctctgaatggactcgcattgcctacttagaaagtgaaatctaaatcccttccaatggcatctaagggcattcacaatccagttcgccgtacrtgatgatgtagtaaaatgtcagccaggaaacttaggaagagaggaaaaacagaaagtattagtaccatttccgccactctgccctctgtacaacagccacattaaactatttattgtgacttattattatgactatgaaactgtcatttcattgctccatccaccaattttgaaagtgatacctttttacaagtttgatttgcatctccagtaaatgtagagagctgagatttccccacatattttaagtaaatgactttgtttttgtcatttttgctatgggtatatgggtatttcat

SEQ ID NO: 677 - DNA, 599 bp, Homo sapiens
taactaaaaatattataaatgttaaatatttaaggagagagacactataaaaaatctatttctgcaaatttataatgtggatagaatgaatcaatttctccaagacacaaagtacaaaaaattcatgaaagaaatagataatttgaatagattttcattttttaaataagtgaaactgataataacctaaaaaatgacaccttgccaattttagtttcactgtttattttgatcaaacatttaaggaaaaagtattacctgttgtccaaaatttcttccagaaaaaggaagcaaaggacrtacttcctaagtcattctttgaggccagcattatgctaatactaaaccatatgcagacatgcataagaaaactatagaccaatacctctcatgaacacagaggcacaaaccatcagcaaaatattagcaaccctaatataacaatgtgttacatttattacagaccacatccaactgggatttatttcaggtacaaaggctggttcaattttcaaaaatcaattattctaatttcaaatacactaacaattaacaatcaaaatttgaagttaaaaaatacatttacaatagcatccaga

SEQ ID NO: 678 - DNA, 599 bp, Homo sapiens
cgctgccagataacaatgctctcgttgtctctttgctcccatctctgggggcctctgattctttctgctctacaggcacgcagcactgacagcctggatggcccaggggagggctcggtgcagcctctacccactgctggggggcccagtgtgaaggggaagcctgggaagaggtgagggtgagggaggaaagggctcagctaggagctggggagactcaaggagctgctggtgacgcatcccctgtctcccaggctctcagctcctcgaggccccttcccgcggctggctgactgcgcycatttccactacgagaacgttgactttggccacattcaggtatgggggctttgcatttgcacccaggagggaagacaatatcctacccaaccttgcaacgatatcaggtgctttgcttctgaaacttatccctgtgactggctgctgcacgcgtctgagcagtcagtagcaaaagttgcaggagccacagcagatggggagagctgctcattcattcatccatttgttcttttattcattcaacaacaacttttgttaggtatctgctctatgtcagggaccaggacatcaccaggccc

SEQ ID NO: 679 - DNA, 599 bp, Homo sapiens
ggcccaccagctctgagcagatcatgaagacaggggcccttttgcttcaggggtgagtttgaggtctgattattgtggcacagatttgaggagtgacaccccgttctgattctgcaccctcactccatccccactctagtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggtgtgggcccctgrggacccagaagtccagccactgggctccttcaggacacaggactctcagccccgcattctcctcctcccctaagaactaggagtctgggccccacaactcagcgcaaacattccggactcccagccctcctctctgccaggatcttaaaaccctccttcagggagtcatttttcccaccttcctaaatgtctgtcttgtccccttcccttgtcccccgttggcctgttgcttttcatttcagcctggcttggggctcagtctccttatctttagtgtgcggtggatgcgggaattttcc

SEQ ID NO: 680 - DNA, 599 bp, Homo sapiens
gttaaaccaggccttggaagcatgttctgcagaggcagccccttgcatggtaaggtgggtctctgtatttgttatcggtggctgtgtaacaaaccaccctgaaatgcagctgcttaaagcagcacccatttaatatataatggtttctgtgggtcagggatgctggtgtggctgaactgcatcctctgcttcagggcctcccactggccgtaattcagatgttggctggggctgtggtctcatctcaagacttgaccagggcaggatccatttgtgagcaagctcagttgttgtgggctrcattcagctacttttggactgttgaactaagggtctcaggttgttgccaactgttggccagaggccgccctctattccttgcaggtgggcctctcccatagggccactcacagcctggcaactagcttcaacaaagagagcaggtgatggaacaggagagggcaaacaagatggaagtcactgtctttactaacctgatctcagatgtgacatcccctcactcttgcccattctgtttgttagggacaagtcactaggtccagcacacactcaaagggtaggcgattataccagaatgt

SEQ ID NO: 681 - DNA, 599 bp, Homo sapiens
gctcaagtaatcctcccacctcagccttctgaataccgggaccacaggcgtgcaccaccatgcccagctttttttttttttttttttttttggtagagacaaggtctccctcttattgcccaggctgttttctaactcccaggctcaagtcaacctcccgcctcggcctcccaaagtgctgggattataggtgtgagccactgcacccagccagaaatacactattaaagataaagaatttctgttatgataaccctaactaacctgccacatcaaaaaagctcagagctgatgactcaytcacctcaaagggccaccatcaaagagacaggctcagagctactacctccaaatgaatcagctgagccacaggctgattaagtgactaagtaaatccaatgtttactgttttagagcagacatcatctgcaacacaaagtcaataaatttaaatgtacccatatatcatcatcattctcaacttggatgattttgaccctcatttggtcatgtctggagacataattggttgtcacaactgtgaggggacaggggtactatagaaatctgtagcatgctgcttaacctcctacaaggca

What is claimed:

1. A method of determining a susceptibility to myocardial infarction in a human individual, comprising:
    analyzing a biological sample from a human individual who has not had a myocardial infarction for the presence or absence of allele T of polymorphic marker rs3184504, and
    determining an increased susceptibility to myocardial infarction for the individual when allele T of the polymorphic marker rs3184504 is present in the biological sample, or determining a decreased susceptibility to myocardial function for the individual when allele T of the polymorphic marker rs3184504 is absent from the biological sample.

2. The method of claim 1, comprising analyzing nucleic acid from the biological sample to determine the presence or absence of allele T of polymorphic marker rs3184504.

3. The method of claim 2, further comprising obtaining the biological sample from the human individual before the analyzing.

4. The method of claim 1, comprising analyzing protein from the biological sample for evidence of the presence or absence of a R262W amino acid variation in the SH2B adaptor protein 3 (SH2B3) protein sequence caused by the presence or absence, respectively, of a T allele of marker rs3184504.

5. The method of claim 1, comprising analyzing nucleic acid in the biological sample for the presence or absence of a R262W codon variation in the deduced amino acid sequence for SH2B adaptor protein 3 (SH2B3) protein caused by the presence or absence, respectively, of a T allele of marker rs3184504.

6. The method of claim 1, wherein determining a susceptibility comprises comparing sequence data for the human individual obtained from the biological sample to a database containing correlation data between polymorphic markers and susceptibility to myocardial infarction, wherein the polymorphic markers in the database include rs3184504.

7. The method of claim 6, wherein the database comprises at least one measure of susceptibility to myocardial infarction for the polymorphic markers.

8. The method of claim 6, wherein the database comprises a look-up table containing at least one measure of susceptibility to myocardial infarction for the polymorphic markers.

9. The method of claim 1, wherein allele T of rs3184504 is determined to be present in the biological sample, and wherein the step of determining a susceptibility to myocardial infarction further comprises calculating a relative risk or an odds ratio of at least about 1.10 for the individual based on allele T being present.

10. The method of claim 1, further comprising reporting the susceptibility to at least one entity selected from the group consisting of the human individual, a guardian of the human individual, a genetic service provider, a physician, a medical organization, and a medical insurer.

11. The method of claim 1, wherein the human individual has Caucasian or European ancestry, as self-reported by the human individual.

12. The method of claim 1, wherein the step of determining an increased or decreased susceptibility is performed using a computer-readable medium having computer executable instructions for determining susceptibility to myocardial infarction, the computer readable medium comprising:
   allelic frequency data indicative of at least one polymorphic marker;
   a routine stored on the computer readable medium and adapted to be executed by a processor to determine risk of developing myocardial infarction based on the data for the at least one polymorphic marker;
   wherein the at least one polymorphic marker comprises rs3184504.

13. The method of claim 12, wherein the computer readable medium contains data indicative of at least two polymorphic markers.

14. The method of claim 1, wherein the step of determining an increased or decreased susceptibility is performed using an apparatus comprising:
   a processor
   a computer readable memory having computer executable instructions adapted to be executed on the processor to analyze marker information for at least one human individual with respect to at least one polymorphic marker comprising marker rs3184504, and generate an output based on the marker information, wherein the output comprises a measure of susceptibility of the at least one marker as a genetic indicator of myocardial infarction for the human individual.

15. The method of claim 14, wherein the computer readable memory further comprises data indicative of the risk of developing myocardial infarction associated with alleles of the at least one polymorphic marker, and wherein a measure of susceptibility for the human individual is based on a comparison of the at least one marker status for the human individual to the risk associated with the at least one-alleles of the at least one polymorphic marker.

16. The method of claim 14, wherein the computer readable memory further comprises data indicative of the frequency of the alleles of the at least one polymorphic marker in a plurality of individuals diagnosed with, or presenting symptoms associated with, myocardial infarction, and data indicative of the frequency of the alleles of the at least one polymorphic marker in a plurality of reference individuals, and wherein risk of developing myocardial infarction is based on a comparison of the frequency of the alleles in individuals diagnosed with, or presenting symptoms associated with, myocardial infarction, and the reference individuals.

17. The method of claim 2, wherein the step of analyzing nucleic acid from the biological sample to determine the presence or absence of allele T of the polymorphic marker rs3184504 comprises at least one nucleic acid analysis technique selected from: analysis using a whole genome SNP chip, cloning for polymorphisms, non-radioactive PCR-single strand conformation polymorphism analysis, denaturing high pressure liquid chromatography (DHPLC), DNA hybridization, single-stranded conformational polymorphism (SSCP), restriction fragment length polymorphism (RFLP), automated fluorescent sequencing; clamped denaturing gel electrophoresis (CDGE); denaturing gradient gel electrophoresis (DGGE), mobility shift analysis, restriction enzyme analysis, heteroduplex analysis, chemical mismatch cleavage (CMC), RNase protection assays, use of polypeptides that recognize nucleotide mismatches, allele-specific PCR, direct manual sequencing, and SNP genotyping.

18. The method of claim 2, wherein the step of analyzing nucleic acid from the biological sample comprises at least one nucleic acid analysis technique selected from SNP chip analysis, polymerase chain reaction, and sequencing.

19. The method of claim 4, wherein the step of analyzing protein from the biological sample for evidence of the presence or absence of a R262W amino acid variation in the SH2B adaptor protein 3 (SH2B3) protein sequence comprises at least one immunoassay with an antibody specific for the R262W amino acid variation.

20. A method of determining a susceptibility to myocardial infarction of a human individual, comprising:
   analyzing a biological sample from a human individual who has not had a myocardial infarction for the presence or absence of allele G of polymorphic marker rs653178; and
   determining an increased susceptibility to myocardial infarction for the human individual when allele G of polymorphic marker rs653178 is present in the biological sample, or
   determining a decreased susceptibility to myocardial function for the individual when allele G of the polymorphic marker rs653178 is absent from the biological sample.

21. The method of claim 20, comprising analyzing nucleic acid from the biological sample to determine the presence or absence of allele G of polymorphic marker rs653178.

22. The method of claim 21, further comprising obtaining a biological sample from the human individual before the analyzing.

23. The method of claim 20, wherein determining a susceptibility comprises comparing sequence data for the human individual obtained from the biological sample to a database containing correlation data between polymorphic markers and susceptibility to myocardial infarction, wherein the polymorphic markers in the database include rs653178.

24. The method of claim 23, wherein the database comprises at least one measure of susceptibility to myocardial infarction for the polymorphic markers.

25. The method of claim 23, wherein the database comprises a look-up table containing at least one measure of susceptibility to myocardial infarction for the polymorphic markers.

26. The method of claim 20, wherein allele G of marker rs653178 is determined to be present in the biological sample, and wherein the step of determining susceptibility to myocardial infarction further comprises calculating a relative risk or an odds ratio of the increased susceptibility of at least about 1.10 for the individual based on allele G being present.

27. The method of claim 20, further comprising reporting the susceptibility to at least one entity selected from the group consisting of the human individual, a guardian of the human individual, a genetic service provider, a physician, a medical organization, and a medical insurer.

28. The method of claim 20, wherein the human individual has Caucasian or European ancestry, as self-reported by the human individual.

29. The method of claim 20, wherein the step of determining an increased or decreased susceptibility is performed using a computer-readable medium having computer executable instructions for determining susceptibility to myocardial infarction, the computer readable medium comprising:
   allelic frequency data indicative of at least one polymorphic marker;
   a routine stored on the computer readable medium and adapted to be executed by a processor to determine risk of developing myocardial infarction based on the data for the at least one polymorphic marker; wherein the at least one polymorphic marker comprises rs653178.

30. The method of claim 29, wherein the computer readable medium contains data indicative of at least two polymorphic markers.

31. The method of claim 20, wherein the step of determining an increased or decreased susceptibility is performed using an apparatus comprising:
   a processor; and a computer readable memory having computer executable instructions adapted to be executed on the processor to analyze marker information for at least one human individual with respect to at least one polymorphic marker comprising marker rs653178, and generate an output based on the marker information, wherein the output comprises a measure of susceptibility of the at least one marker as a genetic indicator of myocardial infarction for the human individual.

32. The method of claim 31, wherein the computer readable memory further comprises data indicative of the risk of developing myocardial infarction associated with alleles of the at least one polymorphic marker, and wherein a measure of susceptibility for the human individual is based on a comparison of the at least one marker status for the human individual to the risk associated with the alleles of the at least one polymorphic marker.

33. The method of claim 31, wherein the computer readable memory further comprises data indicative of the frequency of the alleles of the at least one polymorphic marker in a plurality of individuals diagnosed with, or presenting symptoms associated with, myocardial infarction, and data indicative of the frequency of the alleles of the at least one polymorphic marker in a plurality of reference individuals, and wherein risk of developing myocardial infarction is based on a comparison of the frequency of the alleles in individuals diagnosed with, or presenting symptoms associated with, myocardial infarction, and the reference individuals.

34. The method of claim 21, wherein the step of analyzing nucleic acid from the biological sample to determine the presence or absence of allele G of the polymorphic marker rs653178 comprises at least one nucleic acid analysis technique selected from: analysis using a whole genome SNP chip, cloning for polymorphisms, non-radioactive PCR-single strand conformation polymorphism analysis, denaturing high pressure liquid chromatography (DHPLC), DNA hybridization, single-stranded conformational polymorphism (SSCP), restriction fragment length polymorphism (RFLP), automated fluorescent sequencing; clamped denaturing gel electrophoresis (CDGE), denaturing gradient gel electrophoresis (DGGE), mobility shift analysis, restriction enzyme analysis, heteroduplex analysis, chemical mismatch cleavage (CMC), RNase protection assays, use of polypeptides that recognize nucleotide mismatches, allele-specific PCR, direct manual sequencing, and SNP genotyping.

35. The method of claim 21, wherein the step of analyzing nucleic acid from the biological sample comprises at least one nucleic acid analysis technique selected from SNP chip analysis, polymerase chain reaction, and sequencing.

* * * * *

UNITED STATES PATENT AND TRADEMARK OFFICE
CERTIFICATE OF CORRECTION

PATENT NO. : 8,367,333 B2  Page 1 of 1
APPLICATION NO. : 12/636082
DATED : February 5, 2013
INVENTOR(S) : Gudbjartsson et al.

It is certified that error appears in the above-identified patent and that said Letters Patent is hereby corrected as shown below:

In the Claims

In Column 97, Line 48, in Claim 15, delete "at least one-alleles" and insert -- alleles --, therefor.

Signed and Sealed this
Sixteenth Day of December, 2014

Michelle K. Lee
*Deputy Director of the United States Patent and Trademark Office*